United States Patent 7,129,338 (SECRETORY PROTEIN OR MEMBRANE PROTEIN) - sequence listing, part 2

SEQ ID NO: 313 - DNA, 2568 bp, Homo sapiens
  CDS (382)..(1680)
tccgatcccattccatccgttcctcgtctcctcccggtctgacccgttgcccggccgtggttcgccacaccaggcatccaaagctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtaccccctgggttggagactgctcattttcctcccaaattaatcccagaccccctaaaatattgacaaccttgacaaccccccaaccgaggagccagactttgttttggactaacttccatagccctgtcatggaggcagtgtacctggtagtgaatgggttgggcctggtgctggacgtgctgaccttggtgttggacctcaacttcctgctggtgtcctccctcctggcttccctggcctggctcctggccttcgtctacaacctgccgcacacggtactgactagtcttctgcacttgggccgcggagtcttgctttcattgctggccttgatcgaagccgtggtccggttcacatgtgggggcttgcaggccttgtgtactctgctgtatagctgctgctctggcctagagagcctaaagctcctggggcacctggcctctcatggggcactgcggagcagggagatactgcaccggggcgtcctcaatgtggtctccagtggccatgctttgctgcgccaggcctgtgacatctgtgccattgccatgagcctggtggcttatgtgatcaacagcctggtcaacatctgcctcatcggcactcagaacctcttttccctggtgctggccctgtgggatgcagtgaccgggcctctgtggaggatgacagacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggttcaaatacagaagggcccagggcccaggggcttgcagcttcgtgaggggtctccggcccagtttccaatgaataaagttctcttgacagctc

SEQ ID NO: 314 - protein, 433 aa, Homo sapiens
MEAVYLVVNGLGLVLDVLTLVLDLNFLLVSSLLASLAWLLAFVYNLPHTVLTSLLHLGRGVLLSLLALIEAVVRFTCGGLQALCTLLYSCCSGLESLKLLGHLASHGALRSREILHRGVLNVVSSGHALLRQACDICAIAMSLVAYVINSLVNICLIGTQNLFSLVLALWDAVTGPLWRMTDVVAAFLAHISSSAVAMAILLWTPCQLALELLASAARLLASFVLVNLTGLVLLACVLAVTVTVLHPDFTLRLATQALSQLHARPSYHRLREDVMRLSRLALGSEAWRRVWSRSLQLASWPNRGGAPGAPQGDPMRVFSVRTRRQDTLPEAGRRSEAEEEEARTIRVTPVRGRERLNEEEPPGGQDPWKLLKEQEERKKCVICQDQSKTVLLLPCRHLCLCQACTEILMRHPVYHRNCPLCRRGILQTLNVYL

SEQ ID NO: 315 - DNA, 3624 bp, Homo sapiens
  CDS (16)..(1410)
aagattttcggccccatggccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaggcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcggaactcaggcaaggggcagaatgataacaccagcaatggcactaacgactacataggcagtgtagagaaatggcgttaaatggctcaaaaaggcctgtacatacttctcccaaagcgccactgaaaagatggcatagcttaaaagatggaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagccctttagttctttttcatgttgacagatttgtagacaattacaaaagccaaaaaaggataaaataagcattaggaaggctagccagttattcaatagcaccttgataatgtgggcaaacccttctacaaagtttttgttttgaaaagagcaaaagtaaaaagtgttctgtagtgaggttacatatcaggaacatatgagttgagcagagtaatttggtagtgtaagtcgatgcaaaaatacttctatggtacctattacaagctgaccaagataaaaagaagtatgtaacccactgtgctgtcaagcatcatgattccgggcagttttcattttactgtggattttgctatacttatgcaaggacttacactaacctcctggctgtaaatcaaacaaggtgactgaaagtggcatttatgttttcacaagggacatgcttagaagtgtgaccataaagtcacatcttgtacaatctgctcatgtgtttcatctgtagtaatatagccacaaactggacaagaagctgggtatttgggtttaaaatagattttcttgactctgagcttgtatcagtatttctagcttttgttttgtctgacagtattgcagtcttgaaaatcctgagagctaaaaaactgaaaggaatttttccacaccttgaagtcacagtgttttagagtaaaactattttgtgtacaattgtgtttttaaaatagttagtagatcactatggtatttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaattacaggc

SEQ ID NO: 316 - protein, 465 aa, Homo sapiens [sequence omitted]

SEQ ID NO: 317 - DNA, 2530 bp, Homo sapiens
  CDS (138)..(845)
agtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagcttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgtgggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacac

SEQ ID NO: 318 - protein, 236 aa, Homo sapiens
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 319 - DNA, 1873 bp, Homo sapiens
  CDS (20)..(1768)
acgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggaatagctcggctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtattttttttttaatttgaaggaacactgatgaagccctgccatacccctcccgagtctaataaaacgtataatcac

SEQ ID NO: 320 - protein, 583 aa, Homo sapiens [sequence omitted]

SEQ ID NO: 321 - DNA, 2153 bp, Homo sapiens
  CDS (244)..(1272)
atgcgggttctgcttccaaagccatctcttccagcaggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaggatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccagcgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagcccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactccagcgcctggaggaggcaggggcaggaagcggcctccaagacccttcgccttgggacaggaatgggcacctgcttctgagtccatacaggagaagaaagatctgtttcctctcctcgggcctccttctccctgggctggggactccaggggtggctgggagactgggcagccaccagcaaacagacctgtggcccctgcccggctcccccacccattctgctcccctagagacctcttgtacagaagttgcccccaggtggtggggcccctccttgccctaggctggttggtaaaagagaggaggtcaacacccagcctagccacctctgcctcttgggtcagccctccttgactgtgtcccagccagcaccaggccagcagcctcatccctgccattcagggctgttccagagattcgatcctcttaaggcattatcagtgagcaaatgtgaaggaaatggtgtctggaagaaagttctggttcacatgccttgtagctaagtctttctgcaaacaacctcccttccccccgtcgagtcatttggtgactttgatggggggatttctggttatgtcaaggctctggagacaggaagggcctttggccgccttgggtagttgacctgccttttctgactccgggacgagccagtcctaggctgcctccgggagcacttgaggtatcccgcaggccatgaggacccactgggcagctcctggacagcctcttggctccagcccccacccgaaagtggacactggctccgccctggccacctggggactggcactgtggtgcacagtggcccaatgtggccaacggaagttttataaaagacaaaatgtatatcaataaacattttataacttgc

SEQ ID NO: 322 - protein, 343 aa, Homo sapiens
MAGNCSWEAHPGNRNRMCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSAERCASVIFPAWYWRRRPKRLSAVVCALLWVLSLLVTCLHNYFCVFLGRGAPGAACRHMDIFLGILLFLLCCPLMVLPCLALILHVECRARRRQRSAKLNHVILAMVSVFLVSSIYLGIDWFLFWVFQIPAPFPEYVTDLCICINSSAKPIVYFLAGRDKSQRLWEPLRVVFQRALRDGAELGEAGGSTPNTVTMEMQCPPGNAS

SEQ ID NO: 323 - DNA, 1677 bp, Homo sapiens
  CDS (183)..(515)
aggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccatcctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgt

SEQ ID NO: 324 - protein, 111 aa, Homo sapiens
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 325 - DNA, 1712 bp, Homo sapiens
  CDS (243)..(1511)
ctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagggaatttctttttgcctgggattcaatggaatggaatacttggcctagcttatgccacacttgccaagccatcaagttctctggagaccttcttcgactccctggtgacacaagcaaacatccccaacgttttctccatgcagatgcgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcagtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgagatcgatggtggcgctttctcctgtgcccacccgtcttcaatctctgttctgctcccagatgccttctagattcactgtcttttgattcttgattttcaagctttcaaatcctccctacttccaag

SEQ ID NO: 326 - protein, 423 aa, Homo sapiens [sequence omitted]

SEQ ID NO: 327 - DNA, 3017 bp, Homo sapiens
  CDS (141)..(1343)
gctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactttaaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagctcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagttttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgaaccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgctgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaactt

SEQ ID NO: 328 - protein, 401 aa, Homo sapiens
MMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGRNQQKLRGEDDYNMDENEAESETDKQAALAGNDRNIDVFNVEDQKRDTINLLDQREKRNHTL

SEQ ID NO: 329 - DNA, 2372 bp, Homo sapiens
  CDS (77)..(1255)
aagtggccgccggcgtccgggtacccgagggctctcccgcgttgctggcaccgctggcgccgcggtctcgtagcgcatgggcctcctccgaggcgggctcccatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggcccgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaaggtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctggggggaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaataccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctc

SEQ ID NO: 330 - protein, 393 aa, Homo sapiens
MGLLRGGLPCARAMARLGAVRSHYCALLLAAALAVCAFYYLGSGRETFSSATKRLKEARAGAPAAPSPPALELARGSVAPAPGAKAKSLEGGGAGPVDYHLLMMFTKAEHNAALQAKARVALRSLLRLAKFEAHEVLNLHFVSEEASREVAKGLLRELLPPAAGFKCKVIFHDVAVLTDKLFPIVEAMQKHFSAGLGTYYSDSIFFLSVAMHQIMPKEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 331 - DNA, 3520 bp, Homo sapiens
  CDS (40)..(1875)
gaaattcaggttaacgccattgataaagggattccttccatggcaggtcacagcatggtcctggtggaaattctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgttgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtagctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcggatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatc

SEQ ID NO: 332 - protein, 612 aa, Homo sapiens
MAGHSMVLVEILDVNDNVPEVMVTSLSLPVQEDAQVGTVIALISVSDRDSGANGQVICSLTPHVPFKLVSTYKNYYSLVLDSALDRESVSAYELVVTARDGGSPSLWATARVSVEVADVNDNAPAFAQPEYTVFVKENNPPGCHIFTVSAWDADAQKNALVSYSLVERRVGEHALSSYVSVHAESGKVYALQPLDHEELELLQFQVSARDAGVPPLGSNVTLQVFVLDENDNAPALLATPAGSAGGAVSELVPRSVGAGHVVAKVRAVDADSGYNAWLSYELQPAAVGAHIPFHVGLYTGEISTTRILDEADAPRHRLLVLVKDHGEPALTSTATVLVSLVENGQAPKTSSRASVGAVDPEAALVDINVYLIIAICAVSSLLVLTLLLYTALRCSAPPTVSRCAPGKPTLVCSSAVGSWSYSQQRRQRVCSAESPPKTDLMAFSPSLQLSREDCLNPPSEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 333 - DNA, 1979 bp, Homo sapiens
  CDS (74)..(1474)
atcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagtactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgctgccgcccaccccgcctcggagcctctgggagcagcagtgccactgtgcatggcgtgggctgagccttggtgtgtggccgtcctggtggctgcacacctggcgtcgtcctgggcccttgggaggagcacagctgaccctggttttgctgcagtcccagctggactgttttcccaggcaggattttaatctagaatttagaaacatttgtatttgtaatgacttctggcaaaagcacgtgtcctggccggatgtaactgttctcctttcccagctcctgtttgtgaagggcgtctgttatgctcctgcagtcgccgaggccttggatgtgcagccaggggaggagcgtcctgccggccccgcagggcccccaggactccagggtaaagtgtgggccggtggcgcaagactcagaggtgtgctcgtctctttcctgtcagagtgggcgtccccaggccacggtgcaggcctgagtccttccaccggccccgtccagtcgtccctggaggggctgtggaggaaggacgcctctgtgtggtcaggaagtgaaggggccattggccgcatgccatgtgccacctgcggcttgtgtctcacctgtcatctggactcagcacccaggctgcacgtctgacacctgagaggcgagagagtggggccggcctaggagccaaggctggggccttgcgctctgtccccaggatggtggccttgtttgtcctaaacacacccatcagggtctccacagctcccctgcagtgtgtgcaccccacaatgtctgcggctcttcttccggcgtgtcgggctttgatcacagcatagccacgtcagtggcgtgcgcctctcgcacaggccattctgggtctggtggtgccaggtgccgtgacacgccgtgctgggcttgtgctgcagctgggtggtgtggccctcattctcatgttccagctgctgggcagtgctctgcctgtgtgctgcgcctgcaggctgcgtgtgctgccgtggatctcctgcatcccttgacccctccccccatcagaggaaaggctgctccccgaggcaccgcttccctgtgcggcgctgcagaggggccctcagtgtggcactcctcgtcaaagaaaaataaaggctagaactgc

SEQ ID NO: 334 - protein, 467 aa, Homo sapiens [sequence omitted]

SEQ ID NO: 335 - DNA, 1606 bp, Homo sapiens
  CDS (199)..(1488)
gagaccgacccgccacccgccgtagcccgcgcgcccctggcactcaatccccgccatgtgggggctcctgctcgccctggccgccttcgcgccggccgtcggccctgcccagtctcagaccccaatgacctattccttgaggcccctgcgtcgggatcctctgaccctctagactttcagcatcacaattacaaggccatgaggaagctgatgaagcaggtacaagagcaatgccccaacatcacccgcatctacagcattgggaagagctaccagggcctgaagctgtatgtgatggaaatgtcggacaagcctggggagcatgagctgggggagcctgaggtgcgctacgtggctggcatgcatgggaacgaggccctggggcgggagttgcttctgctcctgatgcagttcctgtgccatgagttcctgcgagggaacccacgggtgacccggctgctctctgagatgcgcattcacctgctgccctccatgaaccctgatggctatgagatcgcctaccaccggggttcagagctggtgggctgggccgagggccgctggaacaaccagagcatcgatcttaaccataattttgctgacctcaacacaccactgtgggaagcacaggacgatgggaaggtgccccacatcgtccccaaccatcacctgccattgcccacttactacaccctgcccaatgccaccgtggctcctgaaacgcgggcagtaatcaagtggatgaagcggatcccctttgtgctaagtgccaacctccacgggggtgagctcgtggtgtcctacccattcgacatgactcgcaccccgtgggctgcccgcgagctcacgcccacaccagatgatgctgtgtttcgctggctcagcactgtctatgctggcagtaatctggccatgcaggacaccagccgccgaccctgccacagccaggacttctccgtgcacggcaacatcatcaacggggctgactggcacacggtccccgggagcatgaatgacttcagctacctacacaccaactgctttgaggtcactgtggagctgtcctgtgacaagttccctcacgagaatgaattgccccaggagtgggagaacaacaaagacgccctcctcacctacctggagcaggtgcgcatgggcattgcaggagtggtgagggacaaggacacggagcttgggattgctgacgctgtcattgccgtggatgggattaaccatgacgtgaccacggcgtggggcggggattattggcgtctgctgaccccaggggactacatggtgactgccagtgccgagggctaccattcagtgacacggaactgtcgggtcacctttgaagagggccccttcccctgcaatttcgtgctcaccaagactcccaaacagaggctgcgcgagctgctggcagctggggccaaggtgcccccggaccttcgcaggcgcctggagcggctaaggggacagaaggattgatacctgcggtttaagagccctagggcaggctggacctgtcaagacgggaaggggaagagtagagagggagggacaaagtgaggaaaaggtgctcattaaagctaccgggcacctt

SEQ ID NO: 336 - protein, 430 aa, Homo sapiens
MRKLMKQVQEQCPNITRIYSIGKSYQGLKLYVMEMSDKPGEHELGEPEVRYVAGMHGNEALGRELLLLLMQFLCHEFLRGNPRVTRLLSEMRIHLLPSMNPDGYEIAYHRGSELVGWAEGRWNNQSIDLNHNFADLNTPLWEAQDDGKVPHIVPNHHLPLPTYYTLPNATVAPETRAVIKWMKRIPFVLSANLHGGELVVSYPFDMTRTPWAARELTPTPDDAVFRWLSTVYAGSNLAMQDTSRRPCHSQDFSVHGNIINGADWHTVPGSMNDFSYLHTNCFEVTVELSCDKFPHENELPQEWENNKDALLTYLEQVRMGIAGVVRDKDTELGIADAVIAVDGINHDVTTAWGGDYWRLLTPGDYMVTASAEGYHSVTRNCRVTFEEGPFPCNFVLTKTPKQRLRELLAAGAKVPPDLRRRLERLRGQKD

SEQ ID NO: 337 - RNA, 30 nt, Artificial Sequence
  Description of Artificial Sequence:an artificially synthesized oligo-cap linker sequence
agcaucgagucggccuuguuggccuacugg

SEQ ID NO: 338 - DNA, 42 bp, Artificial Sequence
  Description of Artificial Sequence:an artificially synthesized oligo(dT) primer sequence
gcggctgaagacggcctatgtggccttttttttttttttttt

SEQ ID NO: 339 - DNA, 21 bp, Artificial Sequence
  Description of Artificial Sequence:an artificially synthesized primer sequence
agcatcgagtcggccttgttg

SEQ ID NO: 340 - DNA, 21 bp, Artificial Sequence
  Description of Artificial Sequence:an artificially synthesized primer sequence
gcggctgaagacggcctatgt

SEQ ID NO: 341 - DNA, 2194 bp, Homo sapiens
  CDS (309)..(1307)
ttctaataacgtcacgtcgataaggggcttaggattgcatctggcctgtgtaagccctctgagttctgcggttcttagagttcccttttcagcactatagctctgccttgttcccttgttcctccttctggcgccccgtgctgtgccccctgcaggagtccaagctgtccccatgctgcgttctggtccggccgcccctcccgtggtgtggccctggccgacccccctcctgcgccccgcttttctcgcagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagtcaggcccactcccaaaaacatcacggtggtggcgggcacagacctggtgctgccctgccacctctcctccaacttggcccatgcccgctggacctttgggggccgggacctgcctgcggaacagcccgggtccttcctctacgatgcccggctccaggccctggttgtgatggctgcccagccccgccatgccggggcctaccactgcttttcagaggagcagggggcgcggctggctgctgaaggctaccttgtggctgtcgtggcaggcccgtcggtgaccttggaggcccgggcccccctggaaaacctggggctggtgtggctggcggtggtggccctgggggctgtgtgcctggtgctgctgctgctggtgctgtcattgcgccggcggctgcgggaagagctggagaaaggggccaaggctactgagaggaccttggtgtaccccctggagctgcccaaggagcccaccagtccccccttccggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaatggagaaaatg

SEQ ID NO: 342 - protein, 333 aa, Homo sapiens
MKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGSFLYDARLQALVVMAAQPRHAGAYHCFSEEQGARLAAEGYLVAVVAGPSVTLEARAPLENLGLVWLAVVALGAVCLVLLLLVLSLRRRLREELEKGAKATERTLVYPLELPKEPTSPPFRPCPEPDEKLWDPVGYYYSDGSLKIVPGHARCQPGGGPPSPPPGIPGQPLPSPTRLHLGGGRNSNANGYVRLQLGGEDRGGLGHPLPELADELRRKLQQRQPLPDSNPEESSV

SEQ ID NO: 343 - DNA, 2788 bp, Homo sapiens
  CDS (22)..(1026)
atagaaggaagaggagcgaacatggcagcgcgttggcggttttggtgtgtctctgtgaccatggtggtggcgctgctcatcgtttgcgacgttccctcagcctctgccaaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtatttcagatgctaaacatgaattcagctccaactttcatcaactttcctgcaaaagggaaacccaaacggggtgatacatatgagttacaggtgcggggtttttcagctgagcagattgcccggtggatcgccgacagaactgatgtcaatattagagtgattagacccccaaattatgctggtccccttatgttgggattgcttttggctgttattggtggacttgtgtatcttcgaagaagtaatatggaatttctctttaataaaactggatgggcttttgcagctttgtgttttgtgcttgctatgacatctggtcaaatgtggaaccatataagaggaccaccatatgcccataagaatccccacacgggacatgtgaattatatccatggaagcagtcaagcccagtttgtagctgaaacacacattgttcttctgtttaatggtggagttaccttaggaatggtgcttttatgtgaagctgctacctctgacatggatattggaaagcgaaagataatgtgtgtggctggtattggacttgttgtattattcttcagttggatgctctctatttttagatctaaatatcatggctacccatacagctttctgatgagttaaaaaggtcccagagatatatagacactggagtactggaaattgaaaaacgaaaatcgtgtgtgtttgaaaagaagaatgcaacttgtatattttgtattacctctttttttcaagtgatttaaatagttaatcatttaaccaaagaagatgtgtagtgccttaacaagcaatcctctgtcaaaatctgaggtatttgaaaataattatcctcttaaccttctcttcccagtgaactttatggaacatttaatttagtacaattaagtatattataaaaattgtaaaactactactttgttttagttagaacaaagctcaaaactactttagttaacttggtcatctgattttatattgccttatccaaagatggggaaagtaagtcctgaccaggtgttcccacatatgcctgttacagataactacattaggaattcattcttagcttcttcatctttgtgtggatgtgtatactttacgcatctttccttttgagtagagaaattatgtgtgtcatgtggtcttctgaaaatggaacaccattcttcagagcacacgtctagccctcagcaagacagttgtttctcctcctccttgcatatttcctactgaaatacagtgctgtctatgattgtttttgttttgttgtttttttgagacggtctcgctgtgtcacacaggctggagtgcagtggcgtgagctcggctgactgcaaactctgcctcccaggtttaagcgattctcctgtcacagcttcccaagtagctgggatttacaggtgtgcaccgccatgccaggctaatttttgtgtttttagtagagacagggtttcgccaagttgtccaggctggtcttgaactcctgggctcaagtgatccgcccgcctcagtctcccaaagtgcgaggatgacatgtgtgagctaccacaccagcaatgtctatgcttctcgatagctgtgaacatgaaaagacatctattgggagtccgaggcaggtggattgcttgaggccaggagttagagaccagcctggccaacaaggcaaaaccccgtctctactaaaaatatgaaaattagctgggcttggtggctcatgcctataatcctagctacttgggaggctgaggcacgagacttgcttaatacctgggaggcggagattgcagtgagccgagatcacgctactgcgctccagcctgagtgatagagtgagactctgtctcaaaaaaaagtatctctaaatacaggattataatttctgcttgagtatggtgttaactaccttgtatttagaaagatttcagattcattccatctccttagttttcttttaaggtgacccatctgtgataaaaatatagcttagtgctaaaatcagtgtaacttatacatggcctaaaatgtttctacaaattagagtttgtcacttattccatttgtacctaagagaaaaataggctcagttagaaaaggactccctggccaggcgcagtgacttacgcctgtaatctcagcactttgggaggccaaggcaggcagatcacgaggtcaggagttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctc

SEQ ID NO: 344 - protein, 335 aa, Homo sapiens
MAARWRFWCVSVTMVVALLIVCDVPSASAKRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 345 - DNA, 1419 bp, Homo sapiens
  CDS (58)..(801)
acactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggaggagtttgaagacattgtgggagactggtacttccaccatcaggagcagcccctacaaaattttctctgtgaaggtcatgtgctcccagctgctgaaactgcatgtctacaggaaacttggactggaaaggagatcacagatggggaagagaaaacagaaggggaggaagagcaggaggaggaggaggaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctattcagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaattttctatatcgctattaaacttttttctttttttct

SEQ ID NO: 346 - protein, 248 aa, Homo sapiens
MGPVRLGILLFLFLAVHEAWAGMLKEEDDDTERLPSKCEVCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQCETMLEEFEDIVGDWYFHHQEQPLQNFLCEGHVLPAAETACLQETWTGKEITDGEEKTEGEEEQEEEEEEEEEEGGDKMTKTGSHPKLDREDL

SEQ ID NO: 347 - DNA, 2617 bp, Homo sapiens
  CDS (143)..(613)
tcttccgggcgccgcagcttcctgccaagcaccgcgcagccgcctccgccgcaggatcccccggtgcaggcctccgtgctggtgcggatcctggagctcagccgcgcgcgccctgcccgatcctgtgccgacccaccgcactatgcgcgccgtgccgctgcccgccccgctcctgccgctgctgctgctcgcgctcctggccgctcccaccgcccgcgccagcagagccgagtccgtctccgcgccgcggcccgaacccgagcgcgagtcgcggccaccgcccggcccggggcccgggaacaccacccggtttgggtctggggcggcgggcggcagcggcagctccaacagcagcggcgacgccttggtgacccgcatttccatcctcctccgcgacctacccaccctcaaggcagccgtgatcgtggcgttcgcctttaccaccctcctcatcgcctgcctgctgctgcgcgtcttcaggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaattgttgacaatagtaaaagagatcaggaggatcaagaatctaaaacaagcctgaaggatgtccaactgtgtatttagaatttccgacattcttctctactggatctacacattggaccccatctgatcctttgctgcttttttggcttggtcaggtcctggcctcattttggcgttacctgtgtcagagttcaaggtggatgtgcttagagctggtcagccccttccagacctggacacgtctgtggctccttttctttcttcctttttttttttaaaaaaaaaaaaggttcagcagaaatcagcgtggctagttcacaaagaatttccagtatcagggaaaaactgtgcgtgtgtgtgtgtgtgtgtgtgcacgtgtgtgcgtgtgcacgtgtgtgatacctataaaacagtttctccttctctgaagggaaaggaaagtgctaggcagcctgtgattagcaacattctttgtgcttttttgttgttcctctgctctgtcacagttctacgttgtttgccttagaaatgtaatttttaaaaaccattttaaaaatgaacggtgatttggctggctggaaaaaatcacactgtcaggggactatatttgaagtcagtctagacggggctggactaggaacccacctggacccaggagaccccacaggacccaggaggtccctgccggaaggcagaggttcaggtgagagtggctcacctctgagctggtgaagtgaggacttgcctgtgacatgacccagggatctgctgctggcttctggagacagggccttgggctgacttctcaggttgattgaggcctcctgactagcggtgttcccaggctagaggtgattggctgcaacaaagatgcttctattagtctattagcagtgccttcgggaccctgggattttgctctctctagaaaggtgttttttatttttttattttttatctcccccttttttcctggctttgctccagggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttccctgttttcccccatctgtttgccagaggggtgggactggcaacagaacagccgtggctgctttatctctcctctccacggtgtactcaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacac

SEQ ID NO: 348 - protein, 157 aa, Homo sapiens
MRAVPLPAPLLPLLLLALLAAPTARASRAESVSAPRPEPERESRPPPGPGPGNTTRFGSGAAGGSGSSNSSGDALVTRISILLRDLPTLKAAVIVAFAFTTLLIACLLLRVFRSGKRLKKTRKYDIITTPAERVEMAPLNEEDDEDEDSTVFDIKYR

SEQ ID NO: 349 - DNA, 2646 bp, Homo sapiens
  CDS (27)..(602)
acgggtgctgcgcctagctgcgcaccatggccgggttgctggcgttgctgggtccggcaggcagggtgggcgcccgggtccggcctcgcgccacctggctcctgggcgccaccgccccctgcgccccgccgcccctggccctggccctgctcccgcccaggctagacgcccggctgctccgcacggcgcgcggggactgccgcggccaccaggaccccagccaggccacggggacaacaggcagcagcgtcagctgcacagaggagaaaaagcaaagcaagtcacagcaactgaaaaagatttttcaagagtatggcactgttggcgtgtcattgcacattggaatctcattaatttccttgggcatattttacatggttgtgtcaagtggtgtggacatgcctgcaatcctgctgaaactcggatttaaagagtccctggtacagtcaaaaatggcagcaggcacaagtaccttcgtggtggcctatgcaatccacaagctgtttgcgccagtgagaatcagcattacgctagtctctgtgcccttgattgtcagatattttcgaaaagtgggattttttaaacctccagctgcaaaaccttaatgaactcttcagtcgtacacactgaaaacctatttcttctaaattacatgatttggattggttttagggttttagggttgtagggtttcttttggagaggtagggggctaattgctatgttctcatggataaactttgccagcaaaaatcaggcttttgaacaattttaattttttgcctcataaattttgtgaatgctattcattatagggcttgtatatataatctaaaatgtcagcaaggcatcggagatgggttaacatctcaaaacaaaatagcctacaaatgttccttgtgggagactttggcgagggtctgtgggtaaaagcaccagggggttaatcttggctcagtttcctaaaaagcattgattaatttaactggcttttaaatatccccttccgctgatatttgttgtcagctgcctacagtttaatatgcagcgttcacaaaacagctgccagtgctacaattaatgaagcaaaacttaatatgtaatcacaatctaaattagcatcaatactttgacattcattacattggtttgggggaagaaaagtagttctggtatgtttcattgatccccagataccttccaatctggacatgatggggctgattccagatggtttttctgaaatttcattaaggtaggtcagcgtcatttgtctctgtttaggtaaaatataaaaaccctgcccagtagcagtggcatcgcttggttcctgatgcccatgttccagaggaattcggataccacaaacagctaagacaatctcagcttttcttagacaatcttctatctcaaacttcagacattccagaattgtcatgatgtttacactgtctgagttaaaaatcctgttcaagaaaaaaaaagattttgtatcacttcttaaaaaggaatattcatagcacttgtcacaaatagaaggcaaccatgagataatacaagccagggagaggcttgtattacatgacaggtgtaattagtctgctgagccagctttacccaatgaagggcatatgtgttagagagattagctaagagtagaaattcgagcatagaggccaggtgcggtggctcacgcctgtaatcccagcactttgggaggttgaggcaggcgtgtcacttgaggccaggagttcgagaccagcctggccaacatgatgaaaccccgtctctactacaaatacaaaaattagccgggtgtggtggcacacgcctgtagtcccagctactggggaggctgaggcagcattgcttgaacccaggaggtggaggttgcagtgagccaagatcacaccactgcactccagcctgggcgacagagggagacactgtctccaaaagaaagaaatcccagcgtagatccaaactgagacactgaggcttcgtccttatagtagtcaggagcaggcgattgaagtaattctgtcctgcggggttcagcatcatgcacgttccccctgggccattctctgatgcagggcacttgctccacctctgggaacccagattcaccagtctgccctgtcacgtagttgaaggagttggatttatctttctggctcctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcaaggtctttcaggtagaactcttcttttaaggcaattagcccattgccaaaaggttttactgtcttaaagctgtctttctgagatctaattccaaggacttctccacagctaagtgagatgcctcacaccattaggtgatgctttggacagaacagagtattttcatcttgtgtttaaagcaattccttggcttcggctcctcaccactttctatgccagtctcccatttatgtccctagtaatgcctatgc

SEQ ID NO: 350 - protein, 192 aa, Homo sapiens
MAGLLALLGPAGRVGARVRPRATWLLGATAPCAPPPLALALLPPRLDARLLRTARGDCRGHQDPSQATGTTGSSVSCTEEKKQSKSQQLKKIFQEYGTVGVSLHIGISLISLGIFYMVVSSGVDMPAILLKLGFKESLVQSKMAAGTSTFVVAYAIHKLFAPVRISITLVSVPLIVRYFRKVGFFKPPAAKP

SEQ ID NO: 351 - DNA, 20 bp, Artificial Sequence
  Description of Artificial Sequence:an artificially synthesized primer sequence
tacggaagtgttacttctgc

SEQ ID NO: 352 - DNA, 20 bp, Artificial Sequence
  Description of Artificial Sequence:an artificially synthesized primer sequence
tgtgggaggttttttctcta

SEQ ID NO: 353 - DNA, 17 bp, Artificial Sequence
  Description of Artificial Sequence:an artificially synthesized primer sequence
gttttcccagtcacgac

SEQ ID NO: 354 - DNA, 17 bp, Artificial Sequence
  Description of Artificial Sequence:an artificially synthesized primer sequence
caggaaacagctatgac

SEQ ID NO: 355 - DNA, 20 bp, Artificial Sequence
  Description of Artificial Sequence:an artificially synthesized primer sequence
ttcccttatctccttcgcag

SEQ ID NO: 356 - DNA, 20 bp, Artificial Sequence
  Description of Artificial Sequence:an artificially synthesized primer sequence
ttcttggtagggtactcaga

SEQ ID NO: 357 - DNA, 20 bp, Artificial Sequence
  Description of Artificial Sequence:an artificially synthesized primer sequence
tcaaaaagccccacaagaga

SEQ ID NO: 358 - DNA, 20 bp, Artificial Sequence
  Description of Artificial Sequence:an artificially synthesized primer sequence
ctcattgccccaaatcagta

SEQ ID NO: 359 - DNA, 19 bp, Artificial Sequence
  Description of Artificial Sequence:an artificially synthesized primer sequence
gcctctggatggaatgtgc

SEQ ID NO: 360 - DNA, 20 bp, Artificial Sequence
  Description of Artificial Sequence:an artificially synthesized primer sequence
tgactttgggaggttgacca

SEQ ID NO: 361 - DNA, 20 bp, Artificial Sequence
  Description of Artificial Sequence:an artificially synthesized primer sequence
catgtacactgtgaccagtc

SEQ ID NO: 362 - DNA, 20 bp, Artificial Sequence
  Description of Artificial Sequence:an artificially synthesized primer sequence
cctttggcttcatgagtgaa

SEQ ID NO: 363 - DNA, 20 bp, Artificial Sequence
  Description of Artificial Sequence:an artificially synthesized primer sequence
cccagtatcaggtgtgtatt

SEQ ID NO: 364 - DNA, 20 bp, Artificial Sequence
  Description of Artificial Sequence:an artificially synthesized primer sequence
gggttcctgaaaactggtat

SEQ ID NO: 365 - DNA, 21 bp, Artificial Sequence
  Description of Artificial Sequence: an artificially synthesized primer sequence
tcctgtggcatccacgaaact

SEQ ID NO: 366 - DNA, 21 bp, Artificial Sequence
  Description of Artificial Sequence: an artificially synthesized primer sequence
gaagcatttgcggtggacgat

SEQ ID NO: 367 - DNA, 808 bp, Homo sapiens
tctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtc

SEQ ID NO: 368 - DNA, 20 bp, Artificial Sequence
  Description of Artificial Sequence:an artificially synthesized primer sequence
aacttccagcaggacaagtt

SEQ ID NO: 369 - DNA, 18 bp, Artificial Sequence
  Description of Artificial Sequence:an artificially synthesized primer sequence
aggaacagagcagagaca

SEQ ID NO: 370 - DNA, 688 bp, Homo sapiens
  "n" may be a, t, c, g, other or unknown
cgaagggtaccgacccggcagaagctcggagctctcggggtatcgaggangcaggcccgcgggcgcacgggcgaacgggccgggagccggagcggcggaggagccggcagcagcggcgcggcgggctccaggcgaggcggtcgacgctcctgaaaacttgcgcgcacgctcgcgccactgcgcccggagcgatgaanatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccnacatgtgcattgccattgcgatttctcttctcatgatcctgatatgtgctatggctacttacggagcgtncaancaacgcgcagcctggatcatcccattcttctgttaccagatctttgactttgccctgaacatgttggttgcaatcactgtgcttatttatccaaactccnttcaggaatacatacngcaactgcctcctaattttccctacananatcatgtcntgtccgtgaatccctacctgtttggtccctattattcctctgttttatttaccnttaa

SEQ ID NO: 371 - DNA, 603 bp, Homo sapiens
  "n" may be a, t, c, g, other or unknown
aggcgtaataatagagaaggtgccagaaagaccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttancccgggcccgcagcggcctanagctcctgctggagctggagcgccgcgggcagtgcggcganagcaacctgcggctgctggggcaactcctgcgcgtgctggcccgccacgacctgctgccgcacctggcgcgcaagcggcgccgggcanttgtctccaaaaacgctatanctatggcacctccagctcttccaaagaaggacagaagggttancttgcccgtccccgtcngcagtcaancaattcttgcaaattcctcaancaagggtcagttgggaanacaaggctccccccccaaccaaa

SEQ ID NO: 372 - DNA, 777 bp, Homo sapiens
  "n" may be a, t, c, g, other or unknown
acactcggcctaggaattcccttatctccttcgcagtgcagctccttcaacctcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaaganaaggattccaaggcccgcctggtgctcacctctgggattgtctttgtcatctcaggggtcctgacgctaatccccgtgttgctggacggcgcatgccgtcatccgggacttctataaccccctggtggctgangcccaaaagcgggagctgggggcctccctctacttgggctgggcggcctcaggccttttgtttgctggggttgggggggttgcttgtgctgcacttgcccctccgggggggggtccccaaggggccccanccattaacattgggccccgcttactccaaacaatcttgccccttgccaatctctccggggggggncctcttgaaatttacccctaacccaaanaaatttaacnttcttgnaacnttgggaaaggggg

SEQ ID NO: 373 - DNA, 461 bp, Homo sapiens
  "n" may be a, t, c, g, other or unknown
gagacggggtggcggctgcagccgggtagggccaggagaccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccanaagttcgactccagctatgacagaaactccactttcaatgtgtttgtgggaaaaggacagctgatcacagggatggaccangctcttgtttggggatgttcgttnaacnaaaanacntttcc

SEQ ID NO: 374 - DNA, 699 bp, Homo sapiens
  "n" may be a, t, c, g, other or unknown
tcttccgggtggggccccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtctgtggttgcggtccagcgggctcctgttcgccacctccttgctgctgtcccacttcttctgttggnatggccctccaagggtccttgggggaaaancctcctggggctgnaaggaaggaaggaaaaaagggcaagcaagccccaanctgnttttaa

SEQ ID NO: 375 - DNA, 575 bp, Homo sapiens
  "n" may be a, t, c, g, other or unknown
gcggctgcagcgggcttgtaggtgtccggctttgctggcccagcaagcctgataagcatgaagctcttatctttggtggccgtggtcgggtgtttgctggtgcccccagctgaagccaacaagagttctgaagatatccggtgcaaatgcatctgtccaccttatagaaacatcagtgggcatatttacaaccagaatgtatcccagaaggactgcaactgcctgcacgtggtggagcccatgccagtgcctggccatgacgtggaggcctactgcctgctgtgcgagtgcaggtacgangaagcgcagcaccaccaccatcaaggtcatcattgtcatctacctgtccgtggtgggtgccctgttgctctacatggccttcctgatgctggtggaccctctgatccgaaagccggatgcatacactgagcaactgcacaatgaggaggagaatgaggatgctcgctctatggcagcagctgctgcatccctcgggggaccccgagcaaacacagtcctggancgtgtggaaagtgcccancancggtggaactgcaggtgcaggancancggaa

SEQ ID NO: 376 - DNA, 840 bp, Homo sapiens
  "n" may be a, t, c, g, other or unknown
gtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgtcctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtangcatggcaggtgccttttgtttcatcctcatacaactantcttacttattgattttgcacattcatggaatgaatcctgggttgaaaaaatggaagaaaggaactccaaaatgttggtatgcanccttgttatcagctacagctctgaattatctgctgtctttaattgctatcgtcctgttccttgtctactacactcntcccacccatttgttccaaaaaacaaggggttccaccantgtcnacatgcnccnccgcctttggggcctccgttatgttcaaactgcccaaaatccca

SEQ ID NO: 377 - DNA, 785 bp, Homo sapiens
  "n" may be a, t, c, g, other or unknown
ggcgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaanctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacantgggaatgtaagacggacttanatattgcatacaaatttggaaaaactgtggtgagctgtgaangctatgantcctctgaagaccagtatgtactaagaagttcttgtggcttggantataatttanattatacagaacttggcctgcaggaactgaaggantctggaaagcagcacggctttgcctctttctctgattattattataagtggtcctcggcggattcctgtaacatgaatggattgattaccatcgtggtactccttgggatccctttgtatctataanctgtttcctgaattgacgggcaagtattctcctcccaccgtactctgaattntcctcccnttttccccaccgtttaccaanaaanttcaccaacttc

SEQ ID NO: 378 - DNA, 574 bp, Homo sapiens
  "n" may be a, t, c, g, other or unknown
aaaaaaaaaaaaaaaaaaaatcgctggcggancggctgggcggcgggccgggcccggggccgcttggaatggcgcctcctccgccttcgccccaactgcttctcctggcagccctcgcnaggctcctgggtcccagcgaggtgatggctggaccggcggaggaggcgggagcccattgtcccgaaagcctgtggcctctgcctccgcaggtgtcaccaaaagtgacctacacacaantgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggaaatggcctgggtaaanccagcctgggctgcccactggctgatgaggaggcggaggaggaagcanaggaagaanaagcatggatctactgtgaaagcctttcagggcctgctccctccgagccaactcccggtaaaaggangctgtgccnaaaaaggtnt

SEQ ID NO: 379 - DNA, 880 bp, Homo sapiens
  "n" may be a, t, c, g, other or unknown
aaataatcttgcttgaagactgacaagatgtccctgtggactcccaaactctactccagatggggaggtgcccttaacaccaagattttaaaagctccaatttcagagcaagagtcgaaaactcacagataaagttatagttatttcagggttctgaaaagacgcanaacatgaagggactcagaagtctggcagcaacaaccttggctcttttcctggtgtttgttttcctgggaaactccagctgcgctccgcagagactgttggagagaaggaactggactcctcaagctatgctctacctgaaaggggcacagggtcgccgcttcatctccgaccagagccggagaaaggacctctccgaccggccactgccggaaagacgaagcccaaatccccaactactaactattccggaggcagcaaccatcttactggcgtcccttcagaaatcaccagaagatgaanaaaaaaactttgatcaaaccagattcctggaagacagtctgcttaactggtgaaaatatactggattatgtttaattatggttctattctctttgaaaacatgaaccatgtgaataaaacctttgggacccttttattccatttgtaatcttaagaacacacacagatagttttattctttcnnaaacaaatatatatanggatgcttaactgaanaacatcatcttctttcattgcttcaggtcctgttttaaatgaaccaaaatgttttccagatcaccttgtgttcttactccttgantttcttaagaatatttatnattataagggtgaaanaactaaagttgttctttcccttttaacttatagccagtacctgtcttgaatcttaagtgtgtttttnnnttcccct

SEQ ID NO: 380 - DNA, 756 bp, Homo sapiens
  "n" may be a, t, c, g, other or unknown
atgtcgccgctgctggggctccggtccgagctgcaggacacctgcacctcgctgggactgatgctgtcggtggtgctgctcatggggctggcccgcgtagtcgcccggcagcagctgcacaggccggtggcccacgccttcgtcctggagtttctagccaccttccagctctgctgctgcacccacgagctgcaactgctgagcgaacagcaccccgcgcaccccacctggacgctgacgctcgtctacttcttctcgcttgtgcatggcctgactctggtgggcacgtccagcaacccgtgcggcgtgatgatgcanatgatgctggggggcatgtcccccgagacgggtgcggtgaggctattggctcanctggttagtgccctgtgcagcaggtactgcacaagcgccttgtggagcttgggtctgacccagtatcacntcagcgagaggagcttcgcttgcaanaatcccatccgantcgacttgctcaaagcggtcatcacagangccgtctgctcctttctcttccacagcgctctgctgcacttccagnaaagtccgaaccaagcttcgtatccacctgctggctgcactccatcacctttttggtctatgcaggaagaagtctaacangaagctgtatttaatcccnactttgggactttcncctacatttcatgtntttttgaattcaaaacctttcccctccagttttttatnagttattactggggtngggctcccttcctttna

SEQ ID NO: 381 - DNA, 510 bp, Homo sapiens
  "n" may be a, t, c, g, other or unknown
gannaagggtcgtnggtgggaaagatggcggcggctctgggaccccttgggtcgtggcagcagtggcggcgatgtttgtcggctcgggatgggtccaggatgttactccttcttcttttgttggggtctgggcaggggccacagcaagtcggggcgggtcaaacgttcnagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaaaaatctgcatggggatggcttggcaatctggtacacaaangatcggatgcagccanggcctgtgtttggaaacatggacaaatttgtggggctgggantatttgtnnacacctacccc

SEQ ID NO: 382 - DNA, 938 bp, Homo sapiens
  "n" may be a, t, c, g, other or unknown
agttcctccttgctctcgcccctactctttctggtgttagatcgagcaaccctctaaaagcagtttagagtggtaaaaaaaaaaaaaacacaccaaacgctcgcagccacaaaagggatgaaatttcttctggacatcctcctgcttctcccgttactgatcgtctgctccctaaagtccttcgtgaagctttttattcctaagagganaaaatcagtcaccggcgaaaccgtgctgattacaggagctgggcatggaattggganactgactgcctatgaatttgctaaacttaaaagcaagctggttctctgggatataaataagcatggactggaggaaacagctgccaaatgcaagggactgggtgccaaggttcatacctttgtggtanactgcagcaaccganaanatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacnaanaataaccatggccatattgtcactgtggcttcggcagctggacatgtctcggtccccttcttactggcttactgttcaagcaaatttgctgctgttgggatttcataaaactttgacagatgaactggctgccttacaaataactgggantcaaaacaacatttctgttgtcctaaattttcgtaaaacactggcttccatccaaaaaatcccaatttccaatttttggggaaccccnctcctgggaaacctgaaagnaaattggttaaaacaaggcttgaatgccttngggaattcctgaactggaaccnaaaaaaaaaaaattttttanttccccn

SEQ ID NO: 383 - DNA, 862 bp, Homo sapiens
  "n" may be a, t, c, g, other or unknown
gaattgcggccgtatgcgcggctctgtggagtgcacctggggttgggggcactgtgcccccagccccctgctcctttggactctacttctgtttgcanccccatttggcctgctgggggaaaanacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgantgccacatttcaaggccaccccatgaacgaccctaccaggacttttgccaatggcagcctggccttcaaggtccaaggccttttccangtccagccgaacaagcccaaccccctcgcctcctgcacacagcananacctgtcagctaaaagtggccctgattggancctctccccgggggaaaccgttccctgttttggggcttggaaggttacccacatttggggccaagggccctgaactgcccctccnattgccaggaaacaaccnctcccatcccaacaaataaatattccnccgggccgtcttcccaatttgggaaccancctactgtngggggg

SEQ ID NO: 384 - DNA, 671 bp, Homo sapiens
  "n" may be a, t, c, g, other or unknown
atcctgagttgtttaggactttctattgtggcaaacttccagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcatgctgacttgctcatcagttttgcacagtggcaattttgggactgatttagaacagaaactccattggaaccccgaggacaaaggttatgtgcttcacatgatcactactgcagcagaatggtctatgtcattttccttctttggttttttcctgacttacattcgtgattttcagaaaatttctttacgggtggaagccaatttacatggattaaccctctatgacactgcaccttgccctattaacaatgaacgaacacggctactttccagagatatttgatgaaaggataaaatatttctgtaatgattatgattctcanggattggggaaaggttcacagaaattgcttatttttctctgaaattttcaaccacttaatcaaggntgacagtnacnctgatgaatgctgataaatcacgaaaacatgaaaagaanccatttganta

SEQ ID NO: 385 - DNA, 727 bp, Homo sapiens
  "n" may be a, t, c, g, other or unknown
ctactctggcaccactctccaggctgccatggggcccagcacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccactgctggaggtggcaganaaggagcgggaggcactcagaactgaggccgacaccatctccgggagagtggatcgtctggagcgggaggtagactatctggagacccagaacccagctctgccctgtgtanagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacaganaagatctacntgttanatgggacacanaatgacacagcctttgtcttcccaaggctgcgtgacttcacccttgccatggctgcccggaaagcttcccgantccgggtgccttcccctgggttagcacanggcanctggtatatggtggctttctttattttgctccgaagnctcctggaaaaactggttggaagtngt

SEQ ID NO: 386 - DNA, 732 bp, Homo sapiens
  "n" may be a, t, c, g, other or unknown
accgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccatcgtcctgggcatgatgaccgccatcctgggggtcttcctctataacaagaccaagtacgatgcaaaccagcaagccaggaagcacctcctccccgtcaccacagcagacctgancagcaaggagcgtcaccggagcccactggagaanccccacaacgggctcctcttcccccagcacggggantatcagtacgggcgcaacaacatcttaacagaacacttccaatacagccggnaganctacccaactcgtacagtttgaaccgctatgatgtgtanantccaanaggacaggaacagactgttgggtgaatccttcccc

SEQ ID NO: 387 - DNA, 518 bp, Homo sapiens
  "n" may be a, t, c, g, other or unknown
cctcctcccctctgccctgtgctgaccagggcctgggagcccccgcacggttcagacagaggggccaggctgaagctggagaggaaccagcgtcacacagacggcctctgagaacttggagaccccgttacccacccagcaggggtgtcaggacaagcatctgctgcaggcttcagcctcaggggcaaaagggagccccggggtcctggtgggggcaccgaccacaggcccggagggtggatgcctgcaggaagctgggctctgtggagcccgaggaggggctggtggccacaccccccggccccctggctcggcggccctcatgcccgccctacgtccactcctgccgctcctgctcctcctccggctgacctcgggggctggcttgctgccagggctgggganccacccgggcgtgtgccccaaccanctcagccccaacctgtgggtggacgcccagagcacctgtgancgcgagtgtancagggaccangactgtgcggctgctgaaaantgct

SEQ ID NO: 388 - DNA, 746 bp, Homo sapiens
  "n" may be a, t, c, g, other or unknown
acgtcggacccggaggccctgaatgccccatgcgcaccccacagctcgcgctcctgcaagtgttctttctggtgttccccgatggcgtccggcctcagccctcttcctccccatcagaggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccangccctggctgcanantttgggaggcgaatcattcacttcaacattccaaacacaatcaccaccatctttttacaaggggtggggacccattcttacttacttccccnagtggtctgtttataanctttgctgaanacaacctgccagnaattggaactnggggga

SEQ ID NO: 389 - DNA, 726 bp, Homo sapiens
  "n" may be a, t, c, g, other or unknown
gttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgatnaaaccattgatgaggaactagaacgggacaagaaggtcacttggattgtggagttctttgccaattggtctaatgactgccaatcatttgcccctatctatgctgacctctcccttaaatacaactgtacagggctaaattttgggaangtggatgttngacgctatactgatgttagtacgcggtacaaaatgagcacatcacccctcaccaagcaactccctaccctgatnctgttccaaggtggcaaggaagcaatgcngcnggccccnnattgacaa

SEQ ID NO: 390 - DNA, 528 bp, Homo sapiens
  "n" may be a, t, c, g, other or unknown
aaaacttccggtgcctgcagagctcggagcggcggaggcaganaccgaggctgcaccggcagangctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggancagcccccacaacatcgatccaagagggggggctcantgggcggcgtgtgctacctgtcgatgggcatggtcgtgctgctcatgggcctcgtgttcgcctctgtctacatctacagatacttcttccttgcgcagctggcccganataacttcttccgctgtggtgtgctgtatgaggactccctgtcctcccaggtccggactcagatggagctggaagangatgtgaaaatctacctcgacnanaactacnagcgcatcaacgtncctgtgccccagtttggcggcggtgaccctgcagacatc

SEQ ID NO: 391 - DNA, 739 bp, Homo sapiens
  "n" may be a, t, c, g, other or unknown
actcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaagaagcggcagatttatggctatgacagcaggttcagcatttttgggaaagacttcctgctcaactaccctttctcaacatcagtgaagttatccacgggctgcacggcaccctggtggcanaaaaacatgtcctcacagcttgcccactgcatacaccgatggaaaaacctattttnaaaggaanccaaaaaactttccaatngggcttcctaaaagcccaantttaaaaaatngtgggtc

SEQ ID NO: 392 - DNA, 793 bp, Homo sapiens
  "n" may be a, t, c, g, other or unknown
gctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctntgagtaacgcttgtaaggaacttgccatctttcttacaacgggcattgtcgtgtcagcttttggactccctattgtatttgccagagcacatctgattgagtggggagcttgtgcacttgttctcacaggaaacacantcatctttgcaactatactaggctttttcttggtctttggaagcaatgacgacttcagctggcagcagtggtgaaaanaaattactgaactattgtcaaatggacttcctgtcatttgttggccattcacgcacacaggganatggggcagttaatgctgaatggtatngcaagcctcttgggggtattttaagtgctcccttctcacttttattgttagcatactattttcaccnagacttgctgaanggattnaaaagatttctcttttgggaaaaacttgactgatttcncacttatctataattatgnctttttgtggtgttccgctgaattttaaatatttatgtntttttnccccgtttaaggttgaatttttttttgggaaaccaatatnccnatgttttaaccncttttttt

SEQ ID NO: 393 - DNA, 783 bp, Homo sapiens
  "n" may be a, t, c, g, other or unknown
tttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgaggcagctgcaatatttaattcagcctttggaagttttttgggcatcgttataacacccctgctcctgctgctttttcttggttcatcttcttctgtgcctttcacatctattttttctcagctttttatgactgttgtggttcctctcatcattggacagattgtccgaagatacatcaaggattggcttgaganaaagaagcctccttttggtgctatcagcagcagtgtactcctcatgatcatctacacaacattctgtgacacgttctctaacccaaatattgacctggataaattcagccttgttctcatactgttcataatattttctatccagctganttttatgcttttaactttcatcttttcaacaaggaataattcgggtttcacaccagcagacacagtggctatcattttctgttctacacacaaatcccttacattggggaattccgatgctgaaaaatcttgtttgcaaggccatgaattatctctctttaatatctgttacccttgctcatctacccacccaanctcaaaattcttcctggggaaantnttntttgggtnccaacaaatccaaattcttgggaattggttttccaagggcaaaaaa

SEQ ID NO: 394 - DNA, 602 bp, Homo sapiens
  "n" may be a, t, c, g, other or unknown
ttgcgacgtcgaggcgctcatggttgcaggcgggcgccgccgttcagttcagggtctgagcctggaggagtgagccaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcangaggacgangacggcgactacgaagagctggtgctagccttgcgttccgangaagacggcctggccgaancacccgagcacggaaccacagccaccttccaccgctgcgccaangatccgtggangttgcctggcacctacgtggtggtgctgaaagaagaaaccacctctcgcantcagaacgcactgcccgccgcctgcangcccangctgccncc

SEQ ID NO: 395 - DNA, 550 bp, Homo sapiens
  "n" may be a, t, c, g, other or unknown
gagcgagcgagcgagcgagttgccgagcgcgcccccgtccctcgcgcgcgatgctcccctggacggcgctcggcctggccctgagcttgcggctggcgctggcgcggagcggcgcggagcgcggtccaccagcatcggccccccgaggggacctgatgttcctgctggacagctcagccagcgtctctcactacganttctcccgggttcgggagtttgtggggcaactggtggctccactgcccctgggcaccggggccctgcgtgccagtctggtgcacgtgggcagtcggccatacaccgagttccccttcggccagcacanctcgggtgaggctgcccaggatgcggtgcgtgcttctgcccancgcatgggtgacacccacactggcctggcgctggtctatgccaaggaacagctgtttgctgaancatcaggtgcccggccaggggtgcccaaagtgctggtgtgggtgacanatggcgggtccnccgaccctgtgggcccccccatgcacganctcaaggacctgggcntcaccgtgtncat

SEQ ID NO: 396 - DNA, 686 bp, Homo sapiens
  "n" may be a, t, c, g, other or unknown
ccagtgagagcggctttccaggacggtgcgatgtgctgcgcagcgaanangcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatnatatttagatccggttctctaattgccaacatgattctaggaattatcattttgaanaaaagatacagtatattcaaatatacctccattgccctggtgtctgtggggatatttatttgcacttttatgtcagcaaagcaggtgacttcccagtccagcttgagtganaatgatgggattcccggccatttgttgtngtggttactaagtattgggggcntttgactttttgctccttcctgatgttcnnccaagggatgggggaatattcccan

SEQ ID NO: 397 - DNA, 615 bp, Homo sapiens
  "n" may be a, t, c, g, other or unknown
tctccctctccaggggcatctccccctccaaggctctgcaaagaactgccctgtcttctagatgccttcttgaggctgcttgtggccacccacagacacttgtaaggagganagaagtcagcctggcaganagactctgaaatgagggattagaggtgttcaaggagcaagagcttcagcctggagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctataacacccttctgggcctgcccgctgacatccaggctgcccangccatgatggtgacatccagtgcaatctcctccctggcctgcattatctctgtggtgggcatganatgcacagtcttctgccaggnaatcccgaaccaaanacanaatggcggtancaggtggaatctttttcatccttgga

SEQ ID NO: 398 - DNA, 675 bp, Homo sapiens
  "n" may be a, t, c, g, other or unknown
gcggtcacgtgactgctgcgggccagccaagatggcggcctcatgcttggtcctgctggcgctgtgtctgctgctgccgctgctgctgctgggaggatggaagcgctggcgccgggggcgggcggcccggcatgtantancggtggtgctgggcgacgtgggccgcancccccgtatgcagtaccacgcgctgtcgttggccatgcacggcttctcggtgaccctcctggggttctgcaactccaaaccccatgatgagctcttgcagaacaacagaattcagattgtggggttgacagaacttcanantcttgcagttgggccccgggttttccagtacggantcaaagttgtacttcaggctatgtacttgctgtggaagctgatgtgganggagccaggtgcctatatctttctccagaaccccccangtctgccgaacattgctgtctgctggttcctgggctgcctttgtggaaacaaactcgtcattgactggcacaactatggctactccatcatgggtctggtgcatggccccaaccatcccctcnttctgctgggcaagtggttaccaaaaaattctttggggcgcctgtcccaccctgaactgtttttttancaatgctatnccaaaaaaactgggcggataactggcacatcagggntntnaac

SEQ ID NO: 399 - DNA, 732 bp, Homo sapiens
  "n" may be a, t, c, g, other or unknown
aggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattganccttcatgtcaagtcccttggagcaagtccaacagttgctggaatagtaggctcctcctatngcattttgcaactcttttctagcacattggtgggctgctggaacgatgtantgggaagacggtcttccttgctggcatgcattctactcagtgctctgggctatctccttctcggancaaccaccaatgtgtttctgtttgtcctgggtanaatcccggcaggtatttttaaaacacactctctccatctcaagggctctactttctgatgtggttccagaaaaaagaacgggccgcttgtaatcgggacacttcaacacagcctccggtgttgggcttcaatcnttggggcccccgtggtcngtggctatcccactgaaattagaaggatgggtttttatctcacaancccntccatcctggctttttgggtccttcnattcctcaatngcttgggttctccgttttgggtttcctttncca

SEQ ID NO: 400 - DNA, 598 bp, Homo sapiens
  "n" may be a, t, c, g, other or unknown
ggctcgcanccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaanaaaggcactacctcctaggacaganaaaatggctgttgaccaggactggcctagtgtttacccagttgcagcaccatttaaaccctctgcagtacctcttcctgttcgaatgggttatccagtaaaaaagggcgtgcccatggcaaagganggaaatctaaaacttttaaagattcccaattttctgcatttgactcctgtagcaattaaaaagcactgtgaagcccttaaagatttttgcactgagtggccaaccgcactggacagtgacnaaaaatgtnagaagcattttccaattgaaattgacagcactgattatgtttcatcaggaccatctgttcggaaccccnnaacacgaattagtantcttaanaatgccctttaaggaagcagaaattacgattatgcagtgtntctactaacagtgttataccatga

SEQ ID NO: 401 - DNA, 758 bp, Homo sapiens
  "n" may be a, t, c, g, other or unknown
tccgatcccattccatccgttcctcgtctcctcccggtctgacccgttgcccggccgtggttcgccacaccaggcatccaaagctgaggtcgctcctacggcctgggctcgccttcgctttananatgtttggcctcttccctcccaaacagcccatcttcaaaacctggactcttggactggcacctggccacctttccctctaccaagactccacttccgtcttacccacttcttcctcanattcttggtaccccctgggttgganactgctcattttcctcccaaattaatcccagaccccctaaaatattgacaaccttgacaaccccccaaccgaggaaccanactttgttttggactaacttccatanccctgtcatggangcagtgtncctggtaatgaatgggttgggcctggtgctggacgtnctgaccttggtgttggacctcaacttcctgctggtgtcctccctcctggcttccctggcctggctcctggccttcgtctacaacctgccgcacacggtactgantaatcttctgcacttggggcgcggaatcttgctttcattgctgggcttgatcgaaacgtggtccggttcacatntnggggnttgcaagccttgtgttctctgctgtataactgctgctctgggctaaaaaaactaaaactcctggggggactggcctctcattgggggactgcngaacaagggaaaaatantgnncccggggggttctccatgtngttctcc

SEQ ID NO: 402 - DNA, 764 bp, Homo sapiens
  "n" may be a, t, c, g, other or unknown
ttgtatgataaggcaggtaaagtgaggaaacatgcaactgaacaggaaaaaactgaagagggattaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtanattatgttttggttatttttggaggggttattggctattctggtgatgatatcaacaaatttctctggatggttaggatagctgaaggagaacatcccaaagacattcgggaaagtgactattttaccccacaggggagaattccgtgttagacaaagcaggatcccctactttgttgaattgccttatgtataaaatgtcatactacaaatttggaaaaaatgccactggattttcntacccccccaggttttgaccgaacacnttattgctgaaattggaaaataaggacnttaaattccaacntttgggaaaaaancctttacat

SEQ ID NO: 403 - DNA, 468 bp, Homo sapiens
  "n" may be a, t, c, g, other or unknown
gtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcaganctggggccactcttcggancaggatggactcagggtcccgaggcaagtcagactgttgcagangctgaaaaccaaacctttgatgacagaattctcagtgaantctaccatcatttcccgttatgccttcactacggttccctgcagaatgctgaacagancttctgaagaccaggacattgagttccagatgcagattccagctgcagctttcatcaccaacttcactatgcttattgganacaaggtgtatcagggcgaaattacngagagagaaaagaanantggtgatagggtnaaagaaaaaaggaataaaaccac

SEQ ID NO: 404 - DNA, 560 bp, Homo sapiens
  "n" may be a, t, c, g, other or unknown
gtgtggagaaagcggcagctgtcccagcggnaagcgacgaagggacgggacccgggagcctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggaaaatgcanttccttttantcttgacagtgttgcaaattccattcactccttattttctgangaaactcctgttgttttgcanttggctcccantgaagaaaga

SEQ ID NO: 405 - DNA, 770 bp, Homo sapiens
  "n" may be a, t, c, g, other or unknown
agtgcctttggcgcactgaggtgcacagggtcccttagccgggcgcagggcgcgcagcccangctgagatccgcggcttccgtaaaagtgagcatggctgggcagcgagtgcttcttctagtgggcttccttctccctggggtcctgctctcagaggctgccaaaatcctgacaatatctacagtaggtggaagccattatctactgatggaccgggtttctcanattcttcaagatcacggtcataatgtcaccatgcttaaccacaaaagangtccttttatgccagattttaaaaaggaanaaaaatcatatcaagttatcagttggcttgcacctgaanatcatcaaagagaatttaaaaaganttttgatttctttctggaagaaactttaggtggcagaagaaaatttgaaaacttattaaatgttctagaatacttggcgttgcagtgcagtcattttttaaatagaaaaggatatcntggattccttaaagaatgagaacttcgacatggttgatagttgaaacttttgactactgtcctttcctgattgctgaaaaacttggggaanccatttgtggccattctttccacttcattcngctctttgggaatttgggctaccaatccccttgtcttatgttcccatattccgttccttgctgactgatccattngacttctggggggcccaaattaaaaaatttccgaatgttcctttaantttcctgccaggaaggcaaccaccccnttgccantcttang

SEQ ID NO: 406 - DNA, 669 bp, Homo sapiens
  "n" may be a, t, c, g, other or unknown
cgaccgagccgagaggaccgagtggggccgaggccagtagccccggggccctgagcagangccgtagcttgcgccgcacccgcggccaggcggagccaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcangattgactggatggttcctgangctcacanacagaactgtaggaagaaaggcaagaaagangacgaatgtcacaattttgtccagattctcgccattgccaatgcctctcacctcctcacttgtggcaccttcgcttttgatccgaaattgcggggttattgatgtgtccaggttccccnggttgaaaaacttgaaaatggncggggggaaatgtccttttgaaccactcncggtcancaacttgttattggctgggggggttctntattct

SEQ ID NO: 407 - DNA, 775 bp, Homo sapiens
  "n" may be a, t, c, g, other or unknown
aatattgccaggtccactggatctcaaatagcccagcaaccattttccaaggggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgangagccacaaacaccagcaatggggatacaaaggaaaatgaaatgcatgtgggaagtcttttaaatgggagaaagtacagtgactcaagtctacctccttcaaactcagggaaaattcaaagtgagactaatccgtgctcactaatcagtaatgggccatcattggaattaggtgagaatggagcatctgggaaacagaactcagaacaaatagacatgccagatatcaaaagtgatttgagaaaaaccgctagttaatggaatctgttgattttganaaaagganatggttctcatttaagcaaaaacattccccaattcataaaactcccntccatgttggaaatggttgaaaatatctcccatgggaaccnccaaggggactttanaatatcnctcn

SEQ ID NO: 408 - DNA, 723 bp, Homo sapiens
  "n" may be a, t, c, g, other or unknown
gaaggaanatggcacctgccggctgctgctgctgctgctgcttctggggcggcgctgtggccgccgcgggcgccgcccggcgtgtcctgctgctgctgctgctgggggtcctgtccgctgggctgcggccaggcgccctggccaccgancactactcgccgctctccctgctcaagcaggagctgcagcaccggcagcagcaagaggccccggcgggcggcggcggctgcagcccgcagtccggggactggggggaccagtactctgccgagtgcggcgantcatcctttttgaacttccatgactcagactgcgaacccaagggatcatcaccctgtgactccttgctttccctcaacactgagaanattctgagccaggccaagtctattgcagaacagaagagattcccgtttgccactgatnatgacagcacaaatgaananttagctattgcttatgtcttgattggcagtggtctgtatgatgaaacaatacggcatttttcaacaatgcttcaggaagancctgatctggttagtgcaatttatggccgaaggatanccnatggaaagaaaggactacatgacattnagaatgctgaacttgctctgttcnaactgaacccaattnattaccttggaaacagatcgtcccagaagttattttaaacnncgaacaaaaattcttgtccccccctggggaacaaattaattgaaancn

SEQ ID NO: 409 - DNA, 735 bp, Homo sapiens
  "n" may be a, t, c, g, other or unknown
anaggcgcggcgtgactgagctacggttctggctgcgtcccanaggcatccggggcagtaaaaccgctgcgatcgcggaggcggcggccaagccgaaaggcaggccgggcaggggtgtcggacgcagggcgctgggccgggtttcggcttcggccacaggagtcatagaggctgggtggtctggcaaggacttgtgcatttgagaactgacaggtgcagcggagacttctaagagggaaaaccaagctttttttctcaaggtgcaatgaaagccttccacactttctgtgttgtccttctggtgtttgggagtgtctctgaagccaagtttgatgattttgaggatgangaggacatantanagtatgatgataatgacttcgctgaatttgaggatgtcatggaagactctgttactgaatctcctcaacgggtcataatcactgaagatgatgaagatganaccactgtgganttggaagggcangatgaaaaccaagaaggagattttgaagatgcagatacccaggagggagatactganagtgaaccctatgatgatgaagaatttgaaggttatgaagacaaaccagatacttcttctancaaaaataaagaccaataaccaattgttgatgttcctgcccccctcccanaacagctggggaaaaattattatctanaaattttgatgggtgactgggtctgcttgctttatatcnnngaattacctcc

SEQ ID NO: 410 - DNA, 673 bp, Homo sapiens
  "n" may be a, t, c, g, other or unknown
aggggacngttgctggcccaggtgagcgggcgcgctggtccaggtgagcgggcgcgtccccccgacggcgctgcctgcccgaggcggttcacgtaaagacagcgagatcctgagggccagccgggaaggaagcgtggatatggagctggctgctgccaagtccggggcccgcgccgctgcctagcgcgtcctggggactctgtggggacgcgccccgcgccgcggctcggggacccgtanagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctaggaggcgaggacngtctctgccagtataaatgcagtgacngatctaancctttcccacgttatggttataaaccctccccaccgaatggatgtggctctccactgtttggtgttcatcttaacattggtntcccttccctgacaaagtgttgcaaccaacacgacaggtgctatganacctgtggcaaaaccagaatgactgtgatgaaaaatccngtattgnctctcccanatctgccgaaatnttc

SEQ ID NO: 411 - DNA, 633 bp, Homo sapiens
  "n" may be a, t, c, g, other or unknown
ctcctgccancgcgctctctgtttctctgcagccccgaagctcgcgaatgtagcaggcgccccaagctcggtcctcaanaagccatggcggaatccaggggccgtctgtacctttggatgtgcttggctgctgcgctggcatctttcctgatgggatttatggtgggctggtttattaagcctctcaaagaaacgaccacttctgtgcgctatcatcnaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactacattcagccaagttggttcattatgatgtcctcttatcttaccccaatganacaaatgccaactatatatcgattgtggatgaacatgaaactgagattttcaaaacatcntaccttgaaccaccaccagatggctatganaatgttncaaatattgtgccaccatataatgctttctcagcccaaggcatgccagaagganatcttgtatatgtgaactatgctcgcnctgaanactttttcaaactagaaagaaanatnggc

SEQ ID NO: 412 - DNA, 467 bp, Homo sapiens
  "n" may be a, t, c, g, other or unknown
aagccgggccccccagcggtcggcgggacggctcccggctgcagtctgcccgcccgccccgcgcgggggccgagtcgcgaagcgcgcctgcgacccggcgtccgggcgcgctgganangacgcgaggagccatgaggcgccagcctgcgaaggtggcggcgctgctgctcgggctgctcttggantgcacanaagccaaaaagcattgctggtatttcgaaagactctatccaacctattatatatgccgctcctacaangactgctgtggctccaggtgctgtgtgcgggccctctccatacaaangctgtggtacttctggttccttctgatgatgggcgtgcttttctgctgcggagccggcttcttcatccggangcgcatgtnccccccgccgctgatctangaccagccttcaatgtgtcctacaccaggcancccccaaatcccggcccangaacccagc

SEQ ID NO: 413 - DNA, 477 bp, Homo sapiens
  "n" may be a, t, c, g, other or unknown
agttccggacgcgggcccagccgcgcctgcgcctccgctcgcctgtggctgcgtcgcgcgctcttcctcggagctatccaggcggctggtgtgcagcaagctccgcgccgaccccggacgcctgacgcctgacgcctgtacccggccccgcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggcgccaacacaggcatcgggaagcagaccgccttggaactggccaggaaangangcaacatcatcctggcctgccgagacatggaaaaatgtgaggcggcagcaaangacatccgcggggagacctcaatcaccatgtctacgcccggcacctgnacttggcttccctcanntctatccnaatgtttgcagca

SEQ ID NO: 414 - DNA, 745 bp, Homo sapiens
  "n" may be a, t, c, g, other or unknown
gcgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacgtgccataactactttattgaagaccttggnttgccancgtggggatcatatactgtttttgctttaacaactctgttttccggactgttattanggactctgtatgatatttgtggcaaatttgcctttggccttcaaaaagggcgcaaaccacagccaatacccatacccttcaaaaanattattancaaaatctgcacaacctttnnaaaaaaagtggn

SEQ ID NO: 415 - DNA, 637 bp, Homo sapiens
  "n" may be a, t, c, g, other or unknown
agacttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaaggagaaagactctggccctacagctgctccgttgaatgtgcaagacaaacaaaggcaaatctaagggccacaagcatcaaaaaccttanaactcaatgtactggttcctccanctcntccatccttgncgtctccaagngtgtgccccat

SEQ ID NO: 416 - DNA, 613 bp, Homo sapiens
  "n" may be a, t, c, g, other or unknown
aaactcccatctccctcaccaagccggaaagtacgagtcggctcagcctggagggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaancacgggccccggggctgggtgatcttcactgtggntctgctgctgaccctggtataggtcatcatcantacangagtggntgat

SEQ ID NO: 417 - DNA, 543 bp, Homo sapiens
  "n" may be a, t, c, g, other or unknown
cttgactttgagcgtccggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctancaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccanccccttttcccccgatccaaggatgtatgcatggaaggtccgtatctatccantcttgggaacgtnctgggacaactgtaaccgttgcaactgccaggagaacaggcagtggcaagtgtgnccaagaaccatgcctggngggatccagncatgnt

SEQ ID NO: 418 - DNA, 474 bp, Homo sapiens
  "n" may be a, t, c, g, other or unknown
gctagagctctcgactctccgctgcgcggcagctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgangtttggtggcaccaagacagacttcctaattttcgatnccaagaaggaatcaacctttgaaganagaaattactggnaatctcaagtcaaccangatatttgaaatatggntcatcctcctgaagttggagga

SEQ ID NO: 419 - DNA, 593 bp, Homo sapiens
  "n" may be a, t, c, g, other or unknown
aagattttcggccccatggccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccanaagaccgggggcaccactttcggccgccacttggtgcgtnacatccagctggagcagccgtgcgantgccgcgtgggtcanaaaaaatgcacttgccaccggccgggtaagcgggaaactggctcttctccaagttctccacgggctggagctgcgggttgcacgccgactggaccgaactcaccagctgtgtgccctccgtgggtggacggcaagcgcgacgccnggctganaacgtccaggaaacttccactacatcaccatcctccgaaanccantgtccnggtacttga

SEQ ID NO: 420 - DNA, 860 bp, Homo sapiens
  "n" may be a, t, c, g, other or unknown
ctccatctcagagcctctcctcaatctcaagcctccactcccctcatgcccaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatgganaaccttgtgacctgtctttgaatataacctggtatctgaaaagcgctgattgttacaatgaaatctataacttcaaggcagaagaagtaganttgtatttggaaaaacttaaggaaaaaagagcttgtctgggaaatatcaaacatcatcaaaattgttccagaactgcagtgaactctttaaaacacagaccttttctggagattttatgcatcgactgcctcttttagganaaaaacaggangctaagganaatggaacaaaccttacctttattggagacaaaaccgcaatgcatgaaccattgcaaacttggcaagatgcaccatacatttttattgtacatattggcatttcatcctcaaaggaatcatcnaaagaaaattcnctgaattaatctttttaccatgactgtttnaaattaaaggtccctatgaaatacctcncacttgaaaaactatcccttgatnaattttttccatggtgaangtnttattggtatatgttcccgtttgggtgttcctgttggcttgggcattggtcctgccctgctacttgggaaaaaantntncct

SEQ ID NO: 421 - DNA, 556 bp, Homo sapiens
  "n" may be a, t, c, g, other or unknown
ctcgacgggcaagcggcgataagaggtggcgtcctccgcggcattgcgagcaccgccagtctgcgccgccaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggaacagaaccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgaatggccgcttctttgtcnccactctcccancattttttcatgcaaaggatnggatattccgcc

SEQ ID NO: 422 - DNA, 575 bp, Homo sapiens
  "n" may be a, t, c, g, other or unknown
accgtaaccagcgccgcggacaccggcaccggcgccacggactccgcangaccccgcgcccgccgccgccgctatgctggggctgctggtggcgttgctggccctggggctcgctgtctttgcgctgctgggcgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgttgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggaacccttcgaggtgcgcaccgcctgctgggctgggacgacgcgcgttctacctggaagcgcgctttgtcacctgcgggacggtttcgtgtgcgcgctgctgcgcttccggcancacctgctgggcacctcacccnaacgcgtcntgcacacctgttcca

SEQ ID NO: 423 - DNA, 517 bp, Homo sapiens
  "n" may be a, t, c, g, other or unknown
agctggcgctggaggcttcggcgtcacgtgctggtctggatttttctcgatgcactggggaaagcggtggactcttatcgtgggagggctcttgatctgtgatttatagataggcacagggaacccaacggcagacaggtcctagtgcccatcagatacccgcggccgggactcgganctgtggggtgtggggaggcggaggcaccaactaagagcggcctancatcgcaaanccgccctcggggcgctcatggcgggacgcctcctgggaaaggctttggccgcggtgtctctctctctggccttggcctctgtgactatcaggtcctcgcgctgccgcggcatccangcgttcagaaactcgttttcatcttcttggtttcatcttaataccaacgtcatgtctggttctaatggttccaaanaaaattctcacaataaggctcggacntctccttacccangttcaaaagttgaacgaagccangttcctaatganaaagtgggctggcttgtt

SEQ ID NO: 424 - DNA, 640 bp, Homo sapiens
  "n" may be a, t, c, g, other or unknown
gaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatnaanatttcagccctgacgggggttatattccacgaatcctttttctggatcccagtggcaaggtgcatcctgaaatcatcaatgagaatggaaaccccagctacaagtntttttatgtcagtgccgagcaagttgttcaggggatgaaggaagctcaggaaaggctgacgggtgatgccttcagaaagaaacatcttgaagatgaattgtaacatgaatgtgccccttctttcatcaaaattagtgttctgggnaaaaaa

SEQ ID NO: 425 - DNA, 388 bp, Homo sapiens
  "n" may be a, t, c, g, other or unknown
gcacaggggagccggctaaaacagactactcccccgtgcagtcgttccctctaccctaataaggctttggcgcctctcccagaactcggtcctggggaatgctctttgcctggtccagccccgacaaacgtggtctgagaacagcggagcgcggaaaccgcggagcatgactcctccgaagctgcgagcgtcgctgtcgccgtcgctgctgctgctgctgagtggttgcctcctcgcggctgctcggagggagaaaggggcggctagcaacgtggcggagccggtccccgggcccactggcggctcctcgggtcgcttcctcagccccgagcagcacgcgtgcagctggcagctcctgctgcccgccccggangccgcancgggcanc

SEQ ID NO: 426 - DNA, 650 bp, Homo sapiens
  "n" may be a, t, c, g, other or unknown
agtctgtcggagtctgtcctcgggagcaggcggagtaaagggacttgagcgagccagttgccggattattctatttcccctccctctctcccgccccgtatctcttttcacccttctcccaccctcgctcgcgtagccatggcgggaaccgtcggcggccactcagtcccattccatctcctcgtcgtccttcggagccgagccgtccgcgcccggcggcggcgggagcccangagcctgccccgccctggggacgaagagctgcagctcctcctgtgcggtgcacgatctgattttctggagagatgtgaanaagactgggtttgtctttggcaccacgctnatcatgctgctttccctggcagctttcagtgtcatcagtgtggtttcttacctcatcctggctcttctctctgtcaccatcagcttcaggatctacaagtccgtcatccaagctgtncagaagtcagaagaagccatccattcaaagcctacctggacgtanacattactctgtcctcagaagctttccataattacatgaatgctgccatggtgcacatcaacagggccctgaaactcnttattcgtctctttctggtnnaaaatctggttgactccttgaaagctggctgtcttcntgtngctga

SEQ ID NO: 427 - DNA, 518 bp, Homo sapiens
  "n" may be a, t, c, g, other or unknown
gtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaaagtgaagttttgctcttgttgcccaggctggagcgcaatggcgcgatcttggctcaccgcaacctctgccacccagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccnaggtctttgggagcaaattcacacagatctcacccgtctggctgcagctgaagagactngccgtganatgtttga

SEQ ID NO: 428 - DNA, 487 bp, Homo sapiens
  "n" may be a, t, c, g, other or unknown
gtgctgcccgctcaccgcccgccatggcccgcgcacccccgctgctcgccgcgttgaccgcgctcctcgccgccgccgctgctggcggagatgccccgccgggcaaaatcgcggtggttggggctgggattgggggctctgctgtggcccattttctccagcagcacttcggacctcgggtgcagatcgacgtgtacgagaagggaaccgtgggtggccgcttggccaccatctcagtcaacaagcagcactatgagagcggggctgcctccttccactccctgagcctgcacatgcaggacttcgtcaagctgctggggctgangcaccggcgcgaggtggtgggcangagcgccatcttcggcggggagcacttcatgctggaggagactgactggtacctgctgaacctcttccgcctctggtggcactatggcatcagcttcctgaggctgcanatgtgggtggaggangtcatgganaattc

SEQ ID NO: 429 - DNA, 612 bp, Homo sapiens
  "n" may be a, t, c, g, other or unknown
agccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtctgtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcanccggggcatnaacctggaaggcccggntca

SEQ ID NO: 430 - DNA, 441 bp, Homo sapiens
  "n" may be a, t, c, g, other or unknown
gctaatatgctccctctcccacaaggcagcgcgccggctcggacgcggccggctaccgagaccctttgtgagagctgtgagctgcgcctgacggtagcaccatgatcatctcaggtggggcgcccggggcgtccgncanctctgcgccgcccgcgcaggaagagggcatgacgtggtggtaccgctggctgtgtcacctgtctggggtgctgggggcagtctcttgcgcgatctctggcctcttcaactgcatcaccatccaccctctgaacatcgcggncggcgtgtggatgatgatggcggtcgttcccatcgtcatcagtctgaccctcaccacgcttctgggcaacgccttcgcctgtgctacgggggtgctgtacggactctctgctctgggcaaaaagggcgatgccatctcctcttcnatgatccannagcaga

SEQ ID NO: 431 - DNA, 716 bp, Homo sapiens
  "n" may be a, t, c, g, other or unknown
ttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctgcaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgaaggcaccgtggctgccggctacaagacttcatcatctgtgtgganatgttctttgcagccctggccctgcggcacgccttcacctacaaaggtctatgctgacaanaagctgggacgcccnagggccgctgttgccccccatnaaanaacatctccanc

SEQ ID NO: 432 - DNA, 652 bp, Homo sapiens
  "n" may be a, t, c, g, other or unknown
gctggcgtgttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagancctagactattaccaaaccatgtctggagtgaangaggccgacttcaangatcttgagactcaaccccatattcca

SEQ ID NO: 433 - DNA, 802 bp, Homo sapiens
  "n" may be a, t, c, g, other or unknown
gcacttcagcttccccccccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacaagcanaaatgttccaaggtgcatcangtgctctngcatccccaagctgggaatggcaaaattccttttcttgggacaactttgaaaccccaatccttctccttcctcaagaaacccaaccaagcggaaaagccangaaatttgggggnatgggggaagncccaa

SEQ ID NO: 434 - DNA, 413 bp, Homo sapiens
  "n" may be a, t, c, g, other or unknown
cccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctgaggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttcccncantn

SEQ ID NO: 435 - DNA, 516 bp, Homo sapiens
  "n" may be a, t, c, g, other or unknown
aggagacgctgcccttccgcagcgatggcatcccggctctgtggaggggccctctggtatgtgtgtccctgtccttctggggcgtggatggtgcctgggacccagctggcaaccagttgaagacgttctccttggaagctcttggccctgaggactttgcctggggcattggccctgccatggcgttccggagggccgagggcacgtctatgatccangccctggccatgacggtggccgagatccccgtgttcctgtacacgacgtttgggcagtctgcattctcccagctacggttgacgccaggcctgcggaaagtcctctttgccacggccctggggactgtggccctggccctggctgcccaccagctgaagaggcgacngangaggaagaagcangttggtcccgagatgggaggggagcagctgggcacggtgcccctccctatcctcttggccangaaggtcccttcagtgaagaaaggatactcnagccggagagtcnanagnccca

SEQ ID NO: 436 - DNA, 588 bp, Homo sapiens
  "n" may be a, t, c, g, other or unknown
tcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcaggctacctcttagccttgggccctctcctttttatcagcatctgcgacgtgtggctgcagctcttctctcgggaccaggcctacgccatcaacctggccgctgtgggcaccgtggccttcggctgcacagtgcagcaatccagcttctacgggtacacggggatgctgcccaagcggtacacgcagggggtgatgaccggggagagcacggcgggcgtgatgatctctctgagccgcatcctcacgaagctgctgctgcccgacgagcgcgccagcacgctcatcttcttcctggtgtcggtggcgctggagctgctgtgtttcctgctgcacctgttagtgcggcgcaacgcttcgtgctcttccataccacacgggcgcgtgacagccaccggggcanggcangcctgggnaagggctatggntaccgcgtgna

SEQ ID NO: 437 - DNA, 740 bp, Homo sapiens
  "n" may be a, t, c, g, other or unknown
acgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccaagggccggaggattaccatcaccggaaatgctgacctgacctttgaccagacggcgtggggggacagtggtgtgtattactgctccgtggtctcagcccaggacctccaggggaacaatgangcctacgcagaagctcatcgtccttgactggctcttcgtggttgtggtatgcctggctgccttcctcatcttcctcctcctgggcatctgctgggtgccantgctgcccgcacaactttctgctgctanttcaggttgcccctgctgccaanacaantgntgctgccccca

SEQ ID NO: 438 - DNA, 736 bp, Homo sapiens
  "n" may be a, t, c, g, other or unknown
acggtggccggagcagccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaagaacaagcggagggctccctgactgtgtacgtgatatctgaacactcctcacttcttccccaggacatgatgagctacattgggcccaagangacagcantggtgcnggggataatgcaccgggagggctttaacatcattggccgccgcatagtccaagtggcccaagccatgtctttgactgangatgtgcttgctgctgctctggntgaccaccttccaaagggacaagtggancgcttaaaanaggcggnctctcaagtccaacttgggctatgagatcacctcaatttantcaaccaa

SEQ ID NO: 439 - DNA, 725 bp, Homo sapiens
  "n" may be a, t, c, g, other or unknown
aaaaagaaagggctggcgaagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccaggtcttccggcagtttcgcttccccgcggccgtggtggtggaggatgacctggaggtggccccggacttcttcgagtactttcaggccacctatccgctgctgaaggccgacccctccctgtggtgcgtctcggcctggaaatgacaacggcaaggagcagatggtggacgccagcaagcctgaactgctctaccgcaccgactttttccctgggcctggggctgggctgctgttggccganctctgggcttaagctggagcccaantgggcaaaangccttctgggaacnactgggattccggnggcccggga

SEQ ID NO: 440 - DNA, 794 bp, Homo sapiens
  "n" may be a, t, c, g, other or unknown
ttctctcaccgggactcgggactcccgggaagtggaccggcagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaaccctcgtcagcaagacagaaatattccaagaggaagtgatattattgtanatctaaaagtcacttttgggaagaagtatatncaaggaaatttttgtgggaaagtagttaagaaacaaaaccctgtgggcaaaggcaaggctcctgggcaaaacgggaagttgcnaatttgtcccggnaaagagnattccgggnccaacccaaacttggggccccctggggcgcntttccaaaaattg

SEQ ID NO: 441 - DNA, 761 bp, Homo sapiens
  "n" may be a, t, c, g, other or unknown
ggtgactgggtggggctgcctcacttctgcctgatttgggaagcgctgcaaggacaaccggctggggtccttgcgcgccgcggctcagggaggagcaccgactgcgccgcaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacanggtgggccgggaggttcatccatgtttggactctttgtggaacatgggccttatgttgtcacaagtaacatgaccttgcgtgacagagacttcccctggaccacaacgctctccatgctttacattgacaatccagtgggcacaagcttcanttttactgatgatacccacgggtattcagtcaatgaggacgatgtagcacggggatttatacagtggcactaattcagtttttccaganatttccggantataaaaataangacttttangtcactggggaatcttatcagggaaatatgtgcancccattg

SEQ ID NO: 442 - DNA, 739 bp, Homo sapiens
  "n" may be a, t, c, g, other or unknown
aaaactctttcttcggctcgcgagctgagaggagcaggtagaggggcagaggcgggactgtcgtctgggggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccggacttcgccacgcagccgcagcacgttcagaacttcctcctgtacagacactgccgccacctcttcgtggggcaactgatccaaaacgtgggccccatccgggctttttggagcaagtactatgtgccagaggtggtgactcagaatgagcggtacccaccctattgtgggggtggtggcttcttgctgtcccgcttcacggccgctgccctgcgccgtgctgcccatgtcttggncatcttccccattgatgatgtcttcctgggtatgtgtctggagcttgagggactgaagcctgcctcccacagcgggatccgcacgtctggcgtncgggctccatcncaacgnctgtcctcctttgaccctggttcaacgagacctgctgctgggnaacgcttccanctta

SEQ ID NO: 443 - DNA, 736 bp, Homo sapiens
  "n" may be a, t, c, g, other or unknown
agaagaggagaagaggttgtgtgggacaagctgctcccgacagaaggatgtcgctgctgagcctgccctggctgggcctcagaccggtggcaatgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaaggactcgacccagatgtcggccacctattcccagggctttacgctgccattgcacccaaggataatctcttcatcaggttcctgaagccctggctgggtgagtacctgcaggtgaaaggggttggggacaaccttgcggggagggtaggggaagtgctgctcttgcccattgtccttggctgccctactaggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcaacacctggcctcagagggcaacantcgtctggacatgtttgagcacatcagcctcaatgaccttggncagtctaaaagaaaatgcatccttcaagcntttgnacagccaattgtcaaggaanaaggcccaanttg

SEQ ID NO: 444 - DNA, 860 bp, Homo sapiens
  "n" may be a, t, c, g, other or unknown
atggcgcccctcagaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttanggtaaggtgacntangttttaagttttagagccagtggtgatgatttatttgtagaaccaattggctttgtgccntgatccanataaacatttctaatgataacttgactttttttttttttgnaaatggagttcgccccctttgccaaggctgaagttcaattgcggggatntcaactcanngnaaacctccaaccttcgggtttcaagggg

SEQ ID NO: 445 - DNA, 768 bp, Homo sapiens
  "n" may be a, t, c, g, other or unknown
atcagacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggncaatgtcacctggatcgaccaggatgggccagtgactgtcaacacctctgacttcctggtgctggntgccanaactaccctggtcacaaccacacgtgcanctgcagctccgcagcctggcanaaacctctcggtggtggcacaaatgacttggtgtcacaatgcttgctccagccccaggccctcccgggaaccatctctggtatncagnnn

SEQ ID NO: 446 - DNA, 677 bp, Homo sapiens
  "n" may be a, t, c, g, other or unknown
aagcgacgacttccgccctccttagggccgtggtcccgtagctaccggtcgcgtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggcgcagaaaaacctgatccagagtcttctcattcaccccccaggtatacagaccagggcggcgaggaggaggaggactatgaaagtgaggagcagttgcagcaccgcatcctgacggcagcccttgaagtttgtgcccgcccacgggtggacagcagaggcgattgcagaaggagcccaagtgtgtatangtgagggtggggccacctaaccaagatgagccaggatggagtcacaccaaggcagagcgggggggcctcatgccttcttccagtctagctcagagcccctcacagctgcaagattgactggtttttttcccccaatagggtgggaactggctttanttttgtnngtttaaaaagaacaataccatgggnagttgggntccttggga

SEQ ID NO: 447 - DNA, 898 bp, Homo sapiens
  "n" may be a, t, c, g, other or unknown
agttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtacaccagaggatcgcttcctggcagaatttgggagctgtttattgcagcactgttgtgccctctgatgatgttacagtggtttatcaaaatgggttacctgtgatatctgtgaggctaccatcccggcgtgaacgctgtcagttcacactcaagcctatctctgactctgttggtgtatttttacgacaactgcaagaagaggatcggggaattgacagagttgctatctattcaccagatggtgttcgcgttgctgcttcaacaggaatagacctcctcctccttgatgactttaagctggtcattaatgacttaacataccacgtacgaccaccaaaaagagacctcttaagtcatgaaaatgcagcaacgctgaatgatgtaaagacattggtccagcagctatacaccacactgtgcattgaagcagcaccagttaaacanggaaagggagcttattgaaagactagaggatctcaaaagagcaactggctcccctggaaaaggtacgaattgagattagcagaaaagctgangaanaagggaccactttggngccaatgggtggccttgcctacaatggcaaaacagttttggcatttttggncccggntttaccctgggtggggaaatattccctggggaacaatcatgggngccaagttaacaatactttcaancaactttatgggaattngccaatgggcaaantgttaggcaataaattttgttaang

SEQ ID NO: 448 - DNA, 607 bp, Homo sapiens
  "n" may be a, t, c, g, other or unknown
attgtgtctggcggcggcgcgcgagcccaccggcggctgcggcggggcgggaagccatggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctgccgctgcgggactcgcccccgctggggcgccggctgctcccgggcggcccggggcgcgccgaccccgagtcctggcgctcgctcctggggctcggngggctggacgccgagtgcggccggcccctcttcgccacctactcgggcctctggaggaagtgctacttcctgggcatcgaccgggacatcgacaccctcatcctgaaaggtattgcgcancgatgcacggccatcaagtaccacttttctcaagcccatccgcttgcgaaacattccttttaatttaaccaagancatacagcaagatganttngcacctgcttcatttaagaatnatcactgctggntttcctcggcat

SEQ ID NO: 449 - DNA, 735 bp, Homo sapiens
  "n" may be a, t, c, g, other or unknown
gcggatcactgaggctgtggcggcactgcgcccggcgctcgcgtccgtccgcccgtccgcccgcccagccatgactgcgccggtccccgcgccgcggatcctgttgccgttgctgttgctgctgctgctaacgccgcctccgggtgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgcccgcccagctaccctggaccaagctaccaagggctaccacaccatgccgcctcagccagggatgccaacaagcaccctanccaatgcaagtacccancaccttacccaacccancccatgggcccaacggcctaacaacaaaaccctgggctggganggagcaaccgng

SEQ ID NO: 450 - DNA, 713 bp, Homo sapiens
  "n" may be a, t, c, g, other or unknown
gatataaaataactgaaatctggaactaatcaactgtgaaaatcaagcaacgagaaagagttgtaaattattttaaaatatctggctcgatcaactttgccagttttagagccagtctttgcaaaaagggagaaacaaaacagatgagacaagaaaggaacatccagcatgctgtgaaccccctgagactggccatgatctgaaagagtaaagctctatccagggaaccttttctgaatcatagtgtcagacttcctgctcttttcaactcccctggttttatcatctctactctgtttcagcaatctactgccatggccacatcctgaatgttgacaataccctaaactgtgccatttataagatctctgacacaccaacctctctcctcttacagctctcaatgatgtatatgacctcagcttattctaatatgcttacagattatacacccgtgatattgatggcagtggctgctgctgtcgtggctgctgctatcacgcctgctgcaacacagaggtgcgactggggctgcacatttcacggaggtgttgggagttccgccccttctgatgtggggaaagagattcccaggtgcccctgcatctgcccaaactgtggctgtggatcggaggctccangttggnanggttgggagcttccgggtgcanctgcgaacggcctcccaaggtgcaaggaccctggngtttctg

SEQ ID NO: 451 - DNA, 716 bp, Homo sapiens
  "n" may be a, t, c, g, other or unknown
attcatttcccccagtgaccttgacaagtcagaagcttgaaagcagggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaagagctttccatccaggtgtcatgcagaattatggggatcacccttgtgagcaaaaaggcgaaccagcagctgaatttcacagaagctaaggaggcctgtaggctgctgggactaagtttggccggcaaggaccaagttgaaacagccttgaaagctagctttgaaacttgcagctatggctgggttggagatggattcgtggtcatctctaggattagcccaaaccccaagtgtgggaaaaatggggtgggtgtcctgatttggaaggttccagtgagccgacagtttgcaacctattgttacaactcatctgatacttggnctaactcgtgcattccagaaattatcaccancaaagatccatattcaacactcaaactggaaacacaanacnacaaaatttattgncagtgacagtacctactcgggngg

SEQ ID NO: 452 - DNA, 590 bp, Homo sapiens
  "n" may be a, t, c, g, other or unknown
ctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatanaagaggatctaactcctttccgaggaggcatctccaggaagatgatggcagaggtantcagacggaagctagggacccactatcagntcactaagaacagactgtaccgggaaaatgactgcatgttcccctcaaggtgtagtggtgttgagcactttattttggaantgatcgggcgtctccctganatgganatggtgatcaatgtacgagattatcctcaggttcctaaatggatggagcctgccatccnagtcttctccttnagtaagacatcagagtaccatgatatcatgtatcctgcttggaacattttgggaaagggggacctgctgtttggccantttancctaanaggtcttggacggtggganctcttcanagaa

SEQ ID NO: 453 - DNA, 750 bp, Homo sapiens
  "n" may be a, t, c, g, other or unknown
gactgggttcgcggccgcgtgcagaggtgcaggcagagcagcctcggaaccgagacgatgcgtgcgctccgcgaccgagccgggctcctcctctgcgtgctgctgctggcggcgctgctggaggcggcgctagggctccccgtgaagaagccgcggctccgcggaccacggcctgggagcctcacgaggctcgcagaggtctcagcctccccagatcctaggcctctgaaggaagaggaggaggcaccactgctccccagaacccacctgcaggcagagccacaccaacatggatgctggactgtcactgagccagcagccatgaccccaggcaacaccacccctcccaggaccccagaggttactccgttgcggctggagctgcagaagctgccgggattggccaagcacaaccttgagtacccctaaccctgatacccaggcttcagcctccccagatcctangcctctgagggaagaggaggaggcacgactgctccccagaacccacctgcaggcaagagctacaccaacatggatgttggactgtcactgagccagcagccctgaccccagggaatgccacgcctcccaaggacccaagangttactcccttgctgctggagctgcaagaaagctgccagaaattggtccacgcaaaccttgagttanccctaaacctgataaccaaggtgaccaatcaaaggttngtggaagggaacccccaagggccnaaggtngtccnatta

SEQ ID NO: 454 - DNA, 740 bp, Homo sapiens
  "n" may be a, t, c, g, other or unknown
tggcggtggcgcggtagcgcgcgatgcagcacaggctaagaggctgcgcaagcgcggggcccgcccctgggaccctccgggccgggcggtttggccccttagcgcccgggcgtcggggcggtaaaaggccggcagaagggaggcacttgaggacccaagtttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcacatcaggactgaagtgaaggatttccagccttatttcaaaggagaaatcttcctggatgaaaagaaaaagttctatggtccacaaaggcgggaagatgatgtttatgggatttatccgtctgggaatgtggtacaacttcttccgagcctggaacggaggcttctctgggaaacctggaangganaaggcttcatccttggggganttttcgtggtgggatnaaggaaaacaagggcaattcttcntgagcaccgag

SEQ ID NO: 455 - DNA, 699 bp, Homo sapiens
  "n" may be a, t, c, g, other or unknown
atgcgggttctgcttccaaagccatctcttccagcaggagagggctctactctgagctcctattttccaaggctccgggccgcgctcggcgctggcctgctgccccggcgggtccgccggccggaggcgggagtcacaggaagagccctccacaaaaggaggcctcggcggatcaggacagctgcaggtgggtgtgcagactggtgagctgccagcaggggcccagacgcgccaggcctggagatggctggaaactgctcctgggaggcccatcccggcaacaggaacaggatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggngtgaagcctcctgccgggcgtcagcgccgaagcgctgcgcctcggtcaacntccccgcctggtnat

SEQ ID NO: 456 - DNA, 783 bp, Homo sapiens
  "n" may be a, t, c, g, other or unknown
atctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattacaggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctangttcttcctgactgctttctccaactgttcacagcaaatgcttggattttatgcagtaggcattactacagtacatggctaatcttcccaaaaaactagctcattaaagatgaaatagaccagctctcttcaatgaagangacaaatagtttatttaaagcanttgttccaataaagataaatanagggaaacttggatgctaaaattacatgaatagggaat

SEQ ID NO: 457 - DNA, 720 bp, Homo sapiens
  "n" may be a, t, c, g, other or unknown
tctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccacccaccttcccacctgaccagccatgggggctgcggtgttttgcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcancagtggtgtcntctctgttaacaagtattttggctgaatgcaacttgggccaaagttgtggttggggaatccaatgggagactcaaccctaattaacttccccggaantttcaanccttttccnggaaca

SEQ ID NO: 458 - DNA, 596 bp, Homo sapiens
  "n" may be a, t, c, g, other or unknown
gcgctgctgtggcggccgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcantaacagtgtcctatttcctccctcangtaacagatctgaatttcctgatgttaaaatactgattgcatttatnagctaca

SEQ ID NO: 459 - DNA, 810 bp, Homo sapiens
  "n" may be a, t, c, g, other or unknown
gctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacaagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgcaacctgtccaatgtgcttaacanctggtgccaatacaaagctcctaagttcgtcagcttcccaaccaagtgctggccaaggcctctaagggatcctgtatgctgatgggaaancttgtgtctcggngcaactacaacactgggagtactgana

SEQ ID NO: 460 - DNA, 681 bp, Homo sapiens
  "n" may be a, t, c, g, other or unknown
gcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcgggcaccagcgaactgcanagcatccancggttggttagcggcttggaagccaagccggacangtcccgcaacgcgtcccgtagacccgtcca

SEQ ID NO: 461 - DNA, 707 bp, Homo sapiens
  "n" may be a, t, c, g, other or unknown
agcgctcccgaggccgcgggagcctgcagagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaaggctttaccttgtgggggtcagaatattcgtggaactggaatgccatagatgangggcccaagagggacattgtcaaggaacttgaggtagccattaggaacagaactgacctgcgttttggactgtacattccctttttgaatggtttcatccgctcttccttganggatgaatccagttcattccaataangcggnaatttccaagtttccaaagacattgccaaaagctcctatgaag

SEQ ID NO: 462 - DNA, 694 bp, Homo sapiens
  "n" may be a, t, c, g, other or unknown
acatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccctttacatggatgcctatgaagtcagtaatactgaatttgagaagtttgtgaactcaactggctatttgacagaggctgagaagtttggcgactcctttgtctttgaaggcatgttgagtgagcaagtgaagaccaatattcaacangcagttgcagctgctccctggtggttacctgtgaaaggcgctaactggagacacccagaanggcctgactctactaatctgcacaaggccggatnatccaattctccaagtgtcctggaaatgatgcnggttgcctaatgcacttgggcaagggaaaac

SEQ ID NO: 463 - DNA, 687 bp, Homo sapiens
  "n" may be a, t, c, g, other or unknown
ctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagaggggctgggccctatgactgtgggtctggggcttttaggcccctttccntcccccttgnggttaacatgncca

SEQ ID NO: 464 - DNA, 601 bp, Homo sapiens
  "n" may be a, t, c, g, other or unknown
aaaaaactctttcttcggctcgcgagctgagaggagcaggtagaggggcagaggcgggactgtcgtctgggggagccgcccaggaggctcctcaggccgaccccagtccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggcccactccacccacccgcccagccccggccccgtgccatgccaacacctctatggtcacccacccgaacttcgccacgcagccgcagcacgttcagaacttcctcctgtacagacactgccgccactttcccctgctgcaggacgtgcccccctctaagtgcgcgcagccggtcttcctgctgctggtgatcaagtcctcccctagcaactatgtgcgccgcgagctgctgcggcgcacgtggggccgcgagcgcaaggtacggggtttgcagctgcgcctcctcttcctggtgggcacagcctcnaacccgcacgangcccgcanggtcaa

SEQ ID NO: 465 - DNA, 609 bp, Homo sapiens
  "n" may be a, t, c, g, other or unknown
aaaaaaaattccgccaagtctctcgctctgcccaggacgcacagatgagagcgctccgaagactgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggncatgagctcagncatctttacggctctggggatcgtgatgggacaagtggtcggactcagggagctcctaggtggccctcaaggcctgn

SEQ ID NO: 466 - DNA, 726 bp, Homo sapiens
  "n" may be a, t, c, g, other or unknown
actcgatcagcccgccggctccggagcggctctgccttcccgagcgcgggacgcggcgccctgggggaggagggcgaagcgacgcggcgatggctccgcgggcactcccggggtccgccgtcctagccgctgctgtcttcgtgggaggcgccgtgagttcgccgctggtggctccggacaatgggagcagccgcgcattgcactccagaacagagacgaccccgtcgcccagcaacgatactgggaatggacacccagaatatattgcatacgcgcttgtccctgtgttctttatcatgggtctctttggcgtcctcatttgccacctgcttaagaagaaaggctatcgttgtacaacagaagcagagcaagatatcgaagaggaaaaggttgaaaagatagaattgaatgacagtgtgaatgaaaacagtgacactgttgggcaaatcgtccactacatcatgaaaaatgaagcgaaatgctgatgtcttaaaggcgatggtagcagataacagcctgtatgatcctgaaagccccgtgacccccagcacaccagggagcccgccagtgagtcctgggcctttgtcaccaggggggacgccagggaagcacgtctgtggccatcatctgcatacggtgggcggtgttgtcaaaagggatgtgtgtcatccggtgtaagcacaancggtggcactttataaagcccactaacangtccagagagna

SEQ ID NO: 467 - DNA, 672 bp, Homo sapiens
  "n" may be a, t, c, g, other or unknown
gaagtagccgcaggcatggcggcggctatgccgcttgctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaacaacacagtcactcccactgcctccttcaaacccctgggtctggccaantgacactgancactactttctgcgctatgctgtgctgccgcgggaggtggtctgcaccgaaaacctcaccccctggnagaagctcttgccctgtagttccaaggcaggcctctctgtgctgntgaaggnaatcgcttgttccacacagctacaactcccagggag

SEQ ID NO: 468 - DNA, 720 bp, Homo sapiens
  "n" may be a, t, c, g, other or unknown
agaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgccggcctcagacatgctgcacatgagatgggacgaggagctggccgccttcgccaaggcctacgcacggcagtgcgtgtggggccacaacaaggagcgcgggcgccgcggcgagaatctgttcgccatcacagacgagggcatggacgtgccgctggccatggaggagtggcaccacgagcgtgagcactacaacctcancgccgccacctgcagcccaggccagatgtgcggccactacacgcaggtggtatgggccaagacaganaggatcggctgtggttcccacttctgtgagaagctccagggtgttgaggagaccaacatcgaattactggtgtgcaactatgagcctccggggaacgtgnaggggaaacggccctaccagggggggactccgtgctcccaattgtccctctggctaccactgcanagaactcctctgtgaacccatctgaagcccggaaagatgctcagggatttgccttacctggtaaatgaggcccatcttccgggcgactgangcatcagactcnanggaaaatgggtac

SEQ ID NO: 469 - DNA, 663 bp, Homo sapiens
  "n" may be a, t, c, g, other or unknown
tgcatgctgaagctctaccggaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatnaagctcatccccctgctctgcatcgtttgcacctccgtggtctggggcttcgcgctcttcttcttcttccagggactcaacacctggcagaaaacccctgcagagtcnanggagcacaaccgggactgcatcctcctcgacttctttaacgaccacgacatctgggacttcctctcctccatcgccatgttcnggtcc

SEQ ID NO: 470 - DNA, 697 bp, Homo sapiens
  "n" may be a, t, c, g, other or unknown
aggtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaaggcgccacctgggcggacagccaggaactctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccaagggcaggcaggggccacactatgcctgcgccctggtaaaggtgacccctgccatttaccaacagcctggcatttcctgccccaaaaggaattgaatggnggagctccanaaactttccatnccaaaggaatctccgtggtttga

SEQ ID NO: 471 - DNA, 704 bp, Homo sapiens
  "n" may be a, t, c, g, other or unknown
atactcctaagctcctcccccggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaattgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaaggtgtccctcaatgcatggttctggcccacagttttccacaccagggacactgacctcacagagaaaatggactacttctgtgcctccactgtcatcctacactcaatctacctgtgctgcgtcaggaccgtggggctgcagcacccagctgtggtcagtgccttccgggctctcctgctgctcatgctgaccgtgcacgtctcctacctgagcctcatccgcttcgactatggctacaacctggtggccaacgtggctattgggcctggtcaacgtggtgtggtggctggcctgggtgcctgtggnaacanccggcggctgcctcacgtgcgcaaagcgcctggtgggtggtccntgctgctgcaaggggctgtccctgctc

SEQ ID NO: 472 - DNA, 659 bp, Homo sapiens
  "n" may be a, t, c, g, other or unknown
aaaaagcgggtccgagccgccgccgcgcgcgcgccgcgcactgcagccccaggccccggccccccacccacgtctgcgttgctgccccgcctgggccaggccccaaaggcaaggacaaagcagctgtcagggaacctccgccggagtcgaatttacgtgcagctgccggcaaccacaggtaccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctatttttttatatgattattctgttacttgtatttattgttcagtcttctgtatcttgcgcttgtttagccctgaaccaagagcaacagggtcagcttctggaggttggttggaacaatacggcaagtgctcgaaatgacatccagagaaatctaaactgctgtgggttccgaagtgttaacccaaatgacacctgtctggctanctgtgttaaaagtgaccactcgtgctcncatgngctccaatcata

SEQ ID NO: 473 - DNA, 700 bp, Homo sapiens
  "n" may be a, t, c, g, other or unknown
aaaagcgctggccggagggcccgcggccgggccgccggggtgagcgtgtcgaggcggctgtggcgcaggcttccagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccaagctccgggaggtctcantgtctgccttcacgacgcacagtcagggccgggcactacacgtggacctctcccacaacctcattcaacgcctcgtgccccaacccacgaagggccgggctgcctgcgcccaacattcagagcctgaanctgggcctggaaaccggntncaatgccgttgccaaacctccgaa

SEQ ID NO: 474 - DNA, 698 bp, Homo sapiens
  "n" may be a, t, c, g, other or unknown
atgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcangtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagcaaaccgcaccaacctgtggcaaggaaagttcccaangggagacaaagctgaggatggcttcatggatctccccanttgnaaat

SEQ ID NO: 475 - DNA, 685 bp, Homo sapiens
  "n" may be a, t, c, g, other or unknown
gaaaacgggatattcagcagtggcctgtggctgccagagcagctcctcaggggaaactaagcgtcgagtcagacggcaccataatcgcctttaaaagtgcctccgccctgccggccgcgtatcccccggctacctgggccgccccgcggcggtgcgcgcgtgagagggagcgcgcgggcagccgagcgccggtgtgagccagcgctgctgccagtgtgagcggcggtgtgagcgcggtgggtgcggaggggcgtgtgtgccggcgcgcgcgccgtggggtgcaaaccccgagcgtctacgctgccatgaggggcgcgaacgcctgggcgccactctgcctgctgctggctgccgccacccagctctcgcggcagcagtccccaaagagacctgttttcacatgtggtggcattcttactggagagtctggatttattggcagtgaangttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggncatgccaatggccagcgcattggccgcttctgtggcactttccggnctggagcccntgtgtcaagtggcaacaaagatgatggtgcaaatga

SEQ ID NO: 476 - DNA, 774 bp, Homo sapiens
  "n" may be a, t, c, g, other or unknown
gcacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtanactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagaaaanatctacgtgttanatgggacacagaatgacacagcctttgtcttcccaagggtgcgtgacttccccttgccatggcttgccccggaaagcttcccgaatccgggttgccttccctgggttaggcacagggcactggtatatggtggctttctttatttttgctcngangctcctgnaaaaactggttggaagtggtgaaatngaaaacactttgcagcttantccaattcc

SEQ ID NO: 477 - DNA, 671 bp, Homo sapiens
  "n" may be a, t, c, g, other or unknown
aggattcttctcatcgcagtgctccaggcagccactaccaatcgattggagttagcctgtgaggaaactggagaggcgtggctggaccaagacctccccccatgtgagcaggcttcctcctcccccaacaaccgttgccaccacgcccagaaacgtccttaagccctggccctcaggggaaaggtagcaggaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttctgaaacgggtcatccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagangccaagtcggagtacatgaggctactgcagaaagtgctggnctactcaatcgagagcaatgctttcatcnatggagagtcgccaactgctttcctaatgccctcatccanccaag

SEQ ID NO: 478 - DNA, 591 bp, Homo sapiens
  "n" may be a, t, c, g, other or unknown
ccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccanggaaactgaactcagtttgcatcagctgctgcaaccaaaaaccnncc

SEQ ID NO: 479 - DNA, 639 bp, Homo sapiens
  "n" may be a, t, c, g, other or unknown
tatgcctgggcagggcgaagccagaggaaactctggtggaggtccgtagcggtcctgacgtgcaaatcggtcgtccgacctgggtataggggcgaaagactaatcgaaccatctagtagctggttccctccgaagtttccctcaggatagctggcgctctcgccgccggaggaagatgaggctgaagattggattcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcanangcagtatctcacatttaagcctcagacattcacctaccatgatcctgtgcttcgcccagggatcctcggtaactttgaacccaaagaacctgagcctnctggagtggttggtggccctgganagaaanccaagcc

SEQ ID NO: 480 - DNA, 550 bp, Homo sapiens
  "n" may be a, t, c, g, other or unknown
ttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcancactgtcaagaatganttctccctcaagaccttaanaggaa

SEQ ID NO: 481 - DNA, 773 bp, Homo sapiens
  "n" may be a, t, c, g, other or unknown
tgttttgtttctttatttgggacttaacggccactcatttctgttggcgccatgcgactgttgccgtgtgcagcagggacctctgccttcctctcctcccagctcacaataggtgcctcttcctcctcccggccatccacgccggcctggttttcggttctggaatacatccaaccctttcgttcgtgttcttttctcctgtcatcttctccgcctggagctcttccatgttctctttgcacaagcgactctatccttccagtttcagatgatttcacctcctcaaagaggcctttgggaccagccttttctaaagctttccttgagaatgctggtcaagatttaccttttaattttgttttttctgtttgttctgtctcctctgccggctgcttgagctccaggatcacagaggacatgagtgttctgttcccactgatgcctggtgccagactgggacacgtgtgctcagccatggctaatgtgcgcaggcagggatggtcacacagtggcctcttggcgctctggccgagtgggaggagcanggggaggagctgtcagaaggagacctgcctagtcacaggcaggtcacagggcttccagaatcccattcangtgatcccctcctgntgggtaaaacaagcacacctcanaagtggtgttttgtcataagttgttcttaatggctcccaaaagcctcaatctccggttttgtccaatttggggattgaagggaagtttgnttgaagtccaangcggtcaacctttcanga

SEQ ID NO: 482 - DNA, 747 bp, Homo sapiens
  "n" may be a, t, c, g, other or unknown
acagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggggctctcggtggagtaggcatcccaggcggtgtggtgggagccggacccgccgccgccgctgccgcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggaagtcggaatttggaggcattcctacttacggggtttggagcctggggggcttttccccggctttggtgtccggagtccggaggtatccccttggaagtcccaagggtgtccccttggntgntccngaa

SEQ ID NO: 483 - DNA, 830 bp, Homo sapiens
  "n" may be a, t, c, g, other or unknown
aactacaccagggccggtgcacctcggggcggcggcgcaggactaggctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcaagtgatcctctaaccagtttatggattantatgaataataatgtagtatgttctttttcanaagttatatttgataatagagaagggagttttatgggaaagtttctttgaangatttttttttttccatttcgaatcaagatttatagcaacaattgggggtttggnaattttggtatggggcctaanaaaggttcctaaagtttcca

SEQ ID NO: 484 - DNA, 855 bp, Homo sapiens
  "n" may be a, t, c, g, other or unknown
atcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagtactccaacgcgaagaatgccgtgcttttcgaggccatcagcttaatcattcaccatgacagtgagccgaacctgctcgtccgtgcctgcaaccagttgggccagtttctgcagcaccgcgagaccaactgcgctacctggcctggagagcatgtgcacgctgccagctctgagttctccatgaggctgtcaagaccacattgagacggcatnaacgccctgaaactgaaccggacctgaacgtncttgccgnccaaccgctt

SEQ ID NO: 485 - DNA, 663 bp, Homo sapiens
  "n" may be a, t, c, g, other or unknown
gaccccggcgcgcgcgcggcggaggacgaggaagagttgtggcgaggcagatcctgccccgtggccgcggccgtctcgtgtcccaccggccttccgggttccagcgccaggcctggtgcctgccccaggaggatgagcatttgcattgcctgcaccttatcgtgcccttccacctgctgaagcagctgtgcctgccgctcttgtgaactgcgaacttccccttacctcctctctctggctcgggagctggctcggccgcctgtcagtgcaatgctgccccatgtggtgctcaccttccggcgcctgggctgcgccttggcgtcctgccggctggcgcctgcgagacacagaggaagtggtcttctgcacacagccccagtggcccgctcggacaggagcgccccggtgttcacccgtgccctggcctttggggacagaatcgccctggttgaccagcacggncgcacacgtacagggagctttattcccgcagccttcgcctgtcccaggagatctgcaggctctgcgggtgtgtcggcggggacctccgggaggagagggtctccttcctatgcgctaacgatgccttctacgtcgtggcccantgggcgtcatggatgantggcggtgtggcagtccccctntacaggaagcattccgcgg

SEQ ID NO: 486 - DNA, 736 bp, Homo sapiens
  "n" may be a, t, c, g, other or unknown
atttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttgactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagatnaagatatacatcagtcaagtatgtgangatgcttctctggcctctgaactctgctgtgcactggntggactgacattg

SEQ ID NO: 487 - DNA, 665 bp, Homo sapiens
  "n" may be a, t, c, g, other or unknown
attcggcgggagcacccagtcctgtacgccaaggaactggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaagccgagggctcgtcggcctcctccccgagcctcccgccaccctggaccccggccctcagccccacatcgatggggccccagcccacaaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgcacccagaacctnaagtcccccaccanggctgcactgggcggtggggacgganccaggatggtggaaggcaaggggc

SEQ ID NO: 488 - DNA, 905 bp, Homo sapiens
  "n" may be a, t, c, g, other or unknown
tctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtcagtataagcctnaagtgcccattcagatgacttatcctctacaaggcttaaccccgggaaggggaccgcttgagttaacatggtgaagccattgggaagccccaaccctgtgatggtaacttgggtgaaagtcgatgatgaaatgccttaacaacgcccgtactgtntg

SEQ ID NO: 489 - DNA, 808 bp, Homo sapiens
  "n" may be a, t, c, g, other or unknown
agaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggcttttttaagatgcctctcttttaactctgggtggaatttaactacaactnttgncctctcggggaggaattgctttggatttgtngccactgtgctacactgggaaca

SEQ ID NO: 490 - DNA, 861 bp, Homo sapiens
  "n" may be a, t, c, g, other or unknown
atcaagtcagagttcgtggtggcttaggatcttcggatcggccaccctcgcccctcgcaccccagcccagggcggcggggactccgagagccccggagagaacgtggcccagccctggagggcaggcggccactcccccagccagaagtctttttttcttttcttcttttttattatttttttctttttttaaaaagttctgaccgtggtttcctggactcttcatgggctttgcttcctacctccttcacccttcactcctgccctcctcttcctcctcctcctcctcctctgtctgtctcctttcacctctgcgccaggtcggtcctccctgccaaccttccccagctccaatatgtagcagtctctctggatggcggagagtgaaggagacggagaaacgcgccccatcccttccgccgcctcctttcccccccgaccctattcaggttttaagtcaaaaatgtcgatatgtcattatgcactttacagatgaggggaggggccgcagtgcgcagaacccaccccaccccccagtgcagacttcggggtctccaccccaggccagcagcgcccactgggctacagcaagccaacaggtcacagaagccaacgaggggactgtttctcttccactcctatcctcttcttgatctttttttttgcattttccttcatttctttaacaaggagagcaaaagctggtttagcagaagctggggctgangtccccatggggtttgggtgcaaggggcatggcacccttttctggccggaaaggganaaggggaaactacccccccaagcctggccttcggcccggccccaaaccggnggactgngctggttcctccgccccca

SEQ ID NO: 491 - DNA, 846 bp, Homo sapiens
  "n" may be a, t, c, g, other or unknown
tgggcgcgcgcccgccccagttatcatggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaactccattaataatatacctctttcatttcctaattgactatgctgaattggtgtttatgataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaaggcagtgctttcctcagtgctatttttcttgccttagcgacataccagtctctgtacccactcaccttgtttgtcccaggactcctctatctcctccagcggcagtacatacctgtgaaaatgaagagcaaagccttctggatcttttcttgggagtatgccatgatgtatgtgggaaacctaatggtaatcatttgcctctccttcttncttctcagctcttgggatttcatcccgnagctatggctttatactttctggtccagatctcacttcaaacattggncttttct

SEQ ID NO: 492 - DNA, 835 bp, Homo sapiens
  "n" may be a, t, c, g, other or unknown
gagaccgacccgccacccgccgtagcccgcgcgcccctggcactcaatccccgccatgtgggggctcctgctcgccctggccgccttcgcgccggccgtcggccctgcccagtctcagaccccaatgacctattccttgaggcccctgcgtcgggatcctctgaccctctagactttcagcatcacaattacaaggccatgaggaagctgatgaagcaggtacaagagcaatgccccaacatcacccgcatctacagcattgggaagagctaccagggcctgaagctgtatgtgatggaaatgtcggacaagcctggggagcatgagctgggggagcctgaggtgcgctacgtggctggcatgcatgggaacgaggccctggggcgggagttgcttctgctcctgatgcagttcctgtgccatgagttcctgcgagggaacccacgggtgacccggctgctctctgagatgcgcattcacctgctgccctccatgaaccctgatggctatgagatcgcctaccaccggggttcagagctggtgggctgggccgagggccgctggaacaaccagagcatcgatcttaaccataattttgctgacctcaacacaccactgtgggaagcacaggacgatgggaaggtgccccacatcgtgcccaaccatcacctgccattgcccacttactacaccctgccaatgccaccgtggcttctgaaacgcggcagtaatcaagtggatgaacngatccctttgngctaagtgccaaccttcacgggggtgagctcgtggngtcctacccattcgacatgacttggacccctgggcttcccgc

SEQ ID NO: 493 - DNA, 455 bp, Homo sapiens
  "n" may be a, t, c, g, other or unknown
aaatttgccattcttagcaactggccagtcaacaactcaactttataatgggaaaactagacgagctgagattcaacccacgtgagcggctgcagagccgctacccttaacagctctctctcgggattctaacattcccttctgtgacggagagacagcaggccgggacacgcatcccaggacggatccacagctggatggggaaggctgcgccaggcgggccggaagcctggcggtggcgtgcaggagccccgccctcctgggctggattcagccgggggcggggccgcgggcggggcctgtggcagcgggaatcccgaccncgcccctttcctcacccctccatttctcgccatggcccctgcactgctcctgatccctgctgccctcgcccctttcatcctggcctttgncaccggagtgnagttcgngcgctttacctcccttcggccact

SEQ ID NO: 494 - DNA, 905 bp, Homo sapiens
  "n" may be a, t, c, g, other or unknown
aggaagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtaacaaactggaatgaaaatccttaatggaagcaataagaaaagccnaaaaagagaagcatatcggtatcttccaaaaggcagcaagccatgaaccatcccaaaagcccctggaaaagaagtggtcattatgcctctttttaatttnggtggaattaccttgcccacaggaattattccaggccagccgaagaagaagatgntttggaaaaaagcttgacttgaaggaaanggctttttccccaaggggan

SEQ ID NO: 495 - DNA, 841 bp, Homo sapiens
  "n" may be a, t, c, g, other or unknown
cattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacgnaccaatttctgacctcggcaggaatgcttcttctgctatgagaaacatcatagaatggctgnctggataagtactgattcctttctgtggc

SEQ ID NO: 496 - DNA, 599 bp, Homo sapiens
  "n" may be a, t, c, g, other or unknown
aggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaannn

SEQ ID NO: 497 - DNA, 869 bp, Homo sapiens
  "n" may be a, t, c, g, other or unknown
ctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaaagctttccagtttgaatttagatgatcacgcaaagaagaaattaattaaacttgtaggagagcgatactgcaagaccacagatgtgcttaccatcaaaacagataggtgccctttaaggaggcagaattacgattatgcagtgtatctactaacagtgttataccatgagtcttggaatactgaagaatgggaaaaagtaagactgaagcagacatggaagagtatatatgggaaaatagcttcatcagaaagaaatatnctggaaacgcttntccagatgaaagcttgttgagaaaaaatatgggaaataaattaaggaanaacttccttggg

SEQ ID NO: 498 - DNA, 779 bp, Homo sapiens
  "n" may be a, t, c, g, other or unknown
gcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcaaggcggtcggcagtctgagccagcagcgcccctttagaagtttctgaggaacangtcgcccggctcatgganaanggatttt

SEQ ID NO: 499 - DNA, 748 bp, Homo sapiens
  "n" may be a, t, c, g, other or unknown
ggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtncccaaagcatcatgtacccgccgntttcttccgcctnggtaccgtgt

SEQ ID NO: 500 - DNA, 727 bp, Homo sapiens
  "n" may be a, t, c, g, other or unknown
aaattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggcttggagcttgctgggcgcgggacctgggggcgggtaatttggagtnggcccctggagtcagtttccttacaccattccganggcccacccagcacgagctacagncttcaaccaag

SEQ ID NO: 501 - DNA, 752 bp, Homo sapiens
  "n" may be a, t, c, g, other or unknown
aacgagctcgggcctcacccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcagatggcttcttaaactcgggcatcatggaagagcgccttctanacgcaatggtgcccttnctcccggttcagcgggaccacgttccggcaactgcgtgcttcaacgaagcttggcccaacttgggccctggaanccca

SEQ ID NO: 502 - DNA, 526 bp, Homo sapiens
  "n" may be a, t, c, g, other or unknown
gcgctcgccgcgctcgcactgaagcccgggccctcgcgcgccgcggttcgccccgcagcctcgccccctgcccacccgggcggccgtagggcggtcacgatgctgccgcccttaccctcccgcctcgggctgctgctgntgctgctcctgtgcccggcgcacgtcggcggactgtggtgggctgtgggcagccccttggttatggaccctaccagcatctgcaggaaggcacggcggctggccgggcggcaggccgagttgtgccaggctgagccggaagtggtggcagagctagctcggggcgcccggctcggngtgcgagagtgccagttccagttccgcttccgccgntggaattgctccagccacagcaaggcctttggacgcatcctgcaacaggacattcgggagacggccttcgtgttcgccatcactgcggccggcgccagccacgccgtcacgcaggcctgtnctatgggcgagctgctgcagngcggctgccaggcgccccgctggcgggnccctc

SEQ ID NO: 503 - DNA, 772 bp, Homo sapiens
  "n" may be a, t, c, g, other or unknown
gtgcgcgttggggcggccggccaatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctggttaaaggaggacgaggaggaagttggtgacagtcangcctgggangaacccacaaactggagcacanagacatggaacctaactactt

SEQ ID NO: 504 - DNA, 735 bp, Homo sapiens
  "n" may be a, t, c, g, other or unknown
agcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtactggcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgatcttgatgatgctgaccagctgangataggaaatgatgggattttcatgttaacttttttcatggcattcctctttaactggattgggtttttcctgtctttttgcctgaccacttcagctgcaggaaggtatggggccatttcaggatttggctctctctaattaaatggatcctgattgtcaggttttccacctatttccctggatattttgatggtcagtactggctctgntggtgntccttggtttaagctttctnctggttctcaga

SEQ ID NO: 505 - DNA, 811 bp, Homo sapiens
  "n" may be a, t, c, g, other or unknown
acgcgaaggctctatcccacgaaaggactgggtgcaccccagaacgaggacgcggagcttccctgttccaagcagcgatgcctggcggagcctgcgtgctggtgatcgcgctgatgttcctggcctggggggaagctcaggagtgctctcctgggggacaccagtttcttcggagtccttatagaagtgtccgttttgactcatggcacctccagcagtcagctgttcaagacctaatatgtgaccattccctctcccctggatggtatagatttctcatccttgacagacctgccgagatgccaaccaaatgtgttgagatgaaccattgtggaactcaggcccccatctggctgtctctgagagattcagaaacactgccatctcctggggagatcaagcaattgacagcttgtgcaacatggcagtttttgttcagcactacaaaagactgctgtctctttcaaatcccagtgtctgtaagaaactgtgggaacttttctgtatacttactacaaccaactcagggatgtatgggctactgtgcggaagggttctttgccaagattgtaaagtccccccacacgtgaaagcatcaaaacagacatctcacatttttccactggacataatgattgagtgtgttaaaaattctttggtttcctcaagtccattcctgttttaattaaaggatgaagaagctatttctgatgcacgattacacccatgtggttctgatgaaactgaaacaggangtgattgngttcgtcagctggctggctcantggcaccttcacctgcaggaaggcca

SEQ ID NO: 506 - DNA, 831 bp, Homo sapiens
  "n" may be a, t, c, g, other or unknown
gacccgccacccgccgtagcccgcgcgcccctggcactcaatccccgccatgtgggggctcctgctcgccctggccgccttcgcgccggccgtcggcccggctctgggggcgcccaggaactcggtgctgggcctcgcgcagcccgggaccaccaaggtcccaggctcgaccccggccctgcatagcagcccggcacagccgccggcggagacagctaacgggacctcagaacagcatgtccggattcgagtcatcaagaagaaaaaggtcattatgaagaagcggaagaagctaactctaactcgccccaccccactggtgactgccgggccccttgtgacccccactccagcagggaccctcgaccccgctgagaaacaagaaacaggctgtcctcctttgggtctggagtccctgcgagtttcagatagccggcttgaggcatccagcagccagtcctttggtcttggaccacaccgaggacggctcaacattcagtcaggcctggaggacggcgatctatatgatggagcctggtgtgctgaggagcaggacgccgatccatggtttcaggtggacgctgggcaccccacccgcttctcgggtgttatcacacagggcaggaactctgtctggaggtatgactgggtcacatcatacaaggtccagttcagcaatgacagtcggacctggtggggaagtaggaaccacagcagtgggatggacgcagtatttnctggccaattcagacccagaaacttcagtgcttgaaccttctggccggagccccaggtggggcccgtttaattnnctggttgcccaaaacttgg

SEQ ID NO: 507 - DNA, 828 bp, Homo sapiens
  "n" may be a, t, c, g, other or unknown
ggctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgactgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggagcagcggccggctggaggtgtgggactccattgaaggggtgctgtgctgcagcagcgaggaggtctcctcaggcattaccgctctggtgttcttggacaaagggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggccgcttggtgactgggagccaagaccacacacttgagagtgttccgtctggaggactcgtgctgnctcttcaccctttaaggncacttaaggggccattaacgaccgggtacattgacccagancatgg

SEQ ID NO: 508 - DNA, 878 bp, Homo sapiens
  "n" may be a, t, c, g, other or unknown
atcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgggttttccaccttctctcacaagaccgtctactttgactttcaagtgggcgatgagcctcccattctcccagacatggggaacagggtcacagctctcacccagggcttcagggtcttctgcctgtagctgccaaaggaagagagaatgagaaaagcccatctacctcttaaaagcccaggcccagtgggaatacgtatcacctgctcatgtcccatggatggagtccgcctgcgtgaccatccatgaggcttctgaaaacggtgattgactcccagacgcattaccggctgcgggaggcccaggaccgggcccgagcggaagaccttaatagcccgagtctcttactggtctgttggcgagacgattgcccttgttcgtggtcaagctttaatcangtgctactggttgaaaagcttcttcacagaaaaacgaccattaacanggcagtccattctagccccggnattctgtt

SEQ ID NO: 509 - DNA, 813 bp, Homo sapiens
  "n" may be a, t, c, g, other or unknown
gcagagtgcagggccacgtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgtttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttncagcactgcccctgctcanctggggaagaaaggccaagagtttgaattcttacaagttgcccctcaaaagtggagttcctggaatgcaatgcccaaggttggnaaa

SEQ ID NO: 510 - DNA, 810 bp, Homo sapiens
  "n" may be a, t, c, g, other or unknown
agctccagtcctggcatctgcccgaggagaccacgctcccggagctctgctgtcttctcagggagactctgaggctctgttgagaatcatgctttggaggcagctcatctattggcaactgctggctttgtttttcctccctttttgcctgtgtcaagatgaatacatggagtctccacaaaccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcaacatgtacagctatgaaatgaagggcaaatcagatacatccagcaatcatgctgtgctgaactagccaaangggatgaggtttggctgcnaatggcaatggcgctnttcatggggaccaccaacgcttcttcacctttgcaggattcctgc

SEQ ID NO: 511 - DNA, 694 bp, Homo sapiens
  "n" may be a, t, c, g, other or unknown
actccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcangggtggaggagcctangaatgcctctctccaggcccaagtcgtgctctccttcaggcctaccctactgcccgctgcgtcctgctggangtgcaagtgcctgctgccttgtgcaatttggncaatctgtgggctctgtggtatatgactgcttn

SEQ ID NO: 512 - DNA, 841 bp, Homo sapiens
  "n" may be a, t, c, g, other or unknown
tatccagaatggtgtttctgaagttcttctgcatgagtttcttctgccacctgtgtcaaggctacttcgatggccccctctacccagagatgtccaatgggactctgcaccactacttcgtgcccgatggggactatgaggagaacgatgaccccgagaagtgccagctgctcttcagggtgagtgaccacaggcgctgctcccagggggaggggagccaggttggcagcctgctgagcctcaccctgcgggaggagttcaccgtgctgggccgccaggtggaggatgctgggcgcgtgctggagggcatcagcaaaagcatctcctacgacctagacggggaagagagctatggcaagtacctgcggcgggagtcccaccagatcggggatgcctactccaactcggacaaatccctcactgagctggagagcaagttcaagcagggccaggaacaggacagccggcaggagagcaggctcaacgaggactttctgggaatgctggtccacaccaggtccctgctgaaggagacactggacatctctgtggggctcagggacaaatacgagctgctggccctcaccattaggagccatgggacccgactaggtcggctgaaaaatgattatcttaaagtataggtggaaggatacaaatgctagaaagagggaatcaaatcagccccgttttggaaggtgggggacagaagatggggctcatttnccccatacctactatttttttatatcccganttgcactttgagaatncatctaaggcatcttttaaaagagaaaaattggacccttgaatgacttggttttaagtttggttttgn

SEQ ID NO: 513 - DNA, 496 bp, Homo sapiens
  "n" may be a, t, c, g, other or unknown
gagcggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgnccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggtcttcggcgtgcagtaccccacctctgtcaacatcacccttcgtctanggaaggcttatgagatcacgtatgtgangctgaagttccacaccagtcgccctgagagctntgccatctacaagcgcagccg

SEQ ID NO: 514 - DNA, 745 bp, Homo sapiens
  "n" may be a, t, c, g, other or unknown
ctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagggaatttctttttgcctgggattcaatggaatggaatacttggcctagcttatgccacacttgccaagccatcaagttctctggagaccttcttcgacttcctggtgacacaagcaaacattcccaacgttttcttcatgcaagatgcgtggagcccggtttgcccgttgctnggatcttgggaaccaacggaaggtaagtctttgnctttgggtgggaaattgaanccaaagtttgg

SEQ ID NO: 515 - DNA, 668 bp, Homo sapiens
  "n" may be a, t, c, g, other or unknown
agatcgcgccaggagaggaggagagctcgggcgagcggcgagcacaggccacgggagctgagcgcagcagagagcagccggagtccgcgcctgactccgcgcgggtcctgagccggccgcagcttgccaggatccccggcgtccttctcgcgccgcttcacgaagagggcgccttcgccgctcgcccagccggagtgcgcacgggcccgctggaaaccgcactcgccgctccctgggcaggccggggcacccgggcacgcagggcgcgcctggcgagcgccccgggaggcggcgtgcaggaccagcggcggccgtgcaggcggaggacttcggcgcggctcctcctgggtgtgaccccgggcgcgcccgccgcgcgacgatgagggcgcggccgcaggtctgcgaggcgctgctcttcgccctggcgctccagaccggcgtgtgctatggcatcaagtggctggcgctgtccaagacaccatcggccctggcactgaaccagacgcaacactgcaagcagctggagggtctggtgtctgcacaggtgcagctgtgccgcagcaacctggagctcatgcacacggtggtgcacgccgnccgcgaggtcatgaaaggccttgtcgncgggcctttgcccacatgcgcttggaacttgctncttccattga

SEQ ID NO: 516 - DNA, 842 bp, Homo sapiens
  "n" may be a, t, c, g, other or unknown
acgcgtggcgcgatggcggcggccccacgcgcgggccggcggcgcgggcagccgctcctggcgctgctgcttctgctgctggcgccactgccgccgggggccccgccgggcgccgacgcctactttcccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaaagcgcacacctgcctacatncctatccgcaagcgagaaccgcccgggcttgctttgcaagttcccattggtgcaacttgaacctttcctgaatcgaacttgccggaaaggcgggngttccaaggaaacccttggncctttttacccaacctttaacccttgaacttacaaccttgggnccctttttgacccaacc

SEQ ID NO: 517 - DNA, 661 bp, Homo sapiens
  "n" may be a, t, c, g, other or unknown
gctgggcgcacggcgcggagccggccggagctcgaggccggcggcggttggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggangtgaaggaacantgtgangagccaat

SEQ ID NO: 518 - DNA, 731 bp, Homo sapiens
  "n" may be a, t, c, g, other or unknown
aagcctcccattacggagcacgagagagtccatgaaggtccccgcgactcccggactggagaaaacggctcttgcgatggggcgaagtccgagctgcggcgggcgttggtccgtgcagggaagtgggaatcgttaggttcgttctggacccgccgccccatggcccaggcgtctcgctcaggtagcctgcctccactcgttatcgtgcccccgctgagggcgcaacccgggggcactggggaggagcagtgggagagaagtcgaacgggcggtcttcgctgggaggttcactgctggccgagcggaacttctggagggacgccgtggtggccgacgccggcggatgtgagcgaggactacgaggctgatgctgcggcctggaggcgggggcccgcaggtggcggcccgatccctcccgcgctgcagcgtctccgggcggtgttgctgcggctgcatcgcgagcgggagcagctcctccaggcccgagactgcgcctaccacctacagtcggctgtgcgactcatgaagaccctgagtcctggctcgccatccggcggccctagccccttgccccagtggtaccgcgacctgcagctgcacccttcccaaggggcggttctgcgaatcggccctggggagactctcgagccgnttgctgctagcgcgccccatcggactagcccgnccaatgcctggagcttgtcatcgagatcaactttncgctctcggcc

SEQ ID NO: 519 - DNA, 792 bp, Homo sapiens
  "n" may be a, t, c, g, other or unknown
actctggcaccactctccaggctgccatggggcccagcacccctctnctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccactgctggaggtggcaganaaggagcgggaggcactcagaactgaggccgacaccatctccgggagagtggatcgtctggagcgggaggtanactatctggagacccagaacccagctctgccctgtgtagagtttgatgagaaggtgactggaggccctgggaccaaaggcaagggaagaaggaatgagaagtacgatatggtgacaggtaaacaatctgaaagcaggcccctaactcttctcagaaccgatattcttccttccttgcttcttactctttttttcactttgtcccagtccattgtggctctgtcttctggaatctgttttagggaaacctctgtaatgccaggtctattaaggagaggttctggggatccaggccgctgtggtacccgctctttctcaattctccctaagattggaggctaccgctgggcaaatgctcactattctncagatcacccaccctgggggagttcctgctggaggcatctaattcttgcctctatttnctttcctgggcttttctcatcagactgnggctacacaatctntcagtgagatcaatgaa

SEQ ID NO: 520 - DNA, 763 bp, Homo sapiens
  "n" may be a, t, c, g, other or unknown
actgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcaaccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagacaagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgntctnggncagtacttctgctcaatcacaatgcacaggctgacggacaagcagcggaagcacctga

SEQ ID NO: 521 - DNA, 778 bp, Homo sapiens
  "n" may be a, t, c, g, other or unknown
agcaacgacgccgggcagcgggagcggcggccgcgccatgtggctgctggggccgctgtgcctgctgctgagcagcgccgcggagagccagctgctccccgggaacaacttcaccaatgagtgcaacataccaggcaacttcatgtgcagcaatggacggtgcatcccgggcgcctggcagtgtgacgggctgcctgactgcttcgacaagagtgatgagaaggagtgccccaaggctaagtcgaaatgtggcccaaccttcttcccctgtgccagcggcatccattgcatcattggtcgcttccggtgcaatgggtttgaggactgtcccgatggcagcgatgaagagaactgcacagcaaaccctctgctttgctccaccgcccgctaccactgcaagaacggcctctgtattgacaagagcttcatctgcgatggacagaataactgtcaagacaacagtgatgaggaaagctgtgaaagttctcaagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctgtggtcctggacacccccaccactgnaacgtcacctacaacgtcaataatggcatncagtatgtggccagccaggcngagca

SEQ ID NO: 522 - DNA, 718 bp, Homo sapiens
  "n" may be a, t, c, g, other or unknown
aaaaactgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgncatgtgcctctttcngggcattcanta

SEQ ID NO: 523 - DNA, 757 bp, Homo sapiens
  "n" may be a, t, c, g, other or unknown
gcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacattgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctcccttcctgtcccctcttctggctctgtgtgggtccaagtgaggcctggactgtccacgctgangcacaacctggaaaggggcctttgcacgtgtcctacacctggagtcctctgctcctttctcanactgcttaaccangaaccactgctt

SEQ ID NO: 524 - DNA, 754 bp, Homo sapiens
  "n" may be a, t, c, g, other or unknown
aaaaaaaaaaaaaaaaaaaaaaaaaaaaaaattcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgntccctactcgaagcccagcatgaccctggagcccaacaaggacctgcggccaggggacatggtgaccatcacgtgcttcaactaccagggctaccctgaggctgangtgttctggcaggatgggcaagggtgttgccccttgactggcaacgttgaccacnttngcaaaatgg

SEQ ID NO: 525 - DNA, 895 bp, Homo sapiens
  "n" may be a, t, c, g, other or unknown
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgagagcaaatgcctcattcaggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaaagaacacatgtgtactgtggtttattttgatgactgcatgtccatacatcagtgtaaaaatatcctgtgaagtncatgggaagcattccaaatatcggttgggtttcataatgcctgcttgcgaatgcattgggtccagaatgtattgactatggtangtaaaactggcaaatgtntgaactgcatgtttaaagaagacaaatgccaaccaanct

SEQ ID NO: 526 - DNA, 650 bp, Homo sapiens
  "n" may be a, t, c, g, other or unknown
aagtggccgccggcgtccgggtacccgagggctctcccgcgttgctggcaccgctggcgccgcggtctcgtagcgcatgggcctcctccgaggcgggctcccatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggcccgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgccgccgctggcttcaagtgcaaggtcatcttncacgatgttgctgtgctgacggataagctcttcccatcgtggangccatgcagaagcacttn

SEQ ID NO: 527 - DNA, 810 bp, Homo sapiens
  "n" may be a, t, c, g, other or unknown
gcgaatgcgaacctggcccgtgcggaaagggcgcggagagccccggcgcggagcaggcgggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaaggtccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcaacccgtgcttgtcttctggccatgccaatgctcaccattgggggaatcctgtttctcatcaccaacctgcagattgggaacctatttggncaacaccgntcgaccatcatactttgnacaatgggagcatttgactctt

SEQ ID NO: 528 - DNA, 771 bp, Homo sapiens
  "n" may be a, t, c, g, other or unknown
agcagcgcaggtgagcgccgcttccggggtcgggcgcctggatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctncaactatcaccagtacattgtgaagtgccatggcaacacgcttctgccccaattcctggggatgtaccgagtcaatgtggacaacgaagacagctacatgcttgtgatgccaatatgtttagccaccgcttnctgtgcacangaagtatgacctcaagggttccctaatgtcccgggagccanc

SEQ ID NO: 529 - DNA, 745 bp, Homo sapiens
  "n" may be a, t, c, g, other or unknown
ggactcggcaggcagcggggaccagggctggcaggttaagcctctgggggtggatcctgaaaggtggtccagccgcctggccctgcgtgggaccctccacctggcagcagacagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttcagcaccaggaggagagcctggctcaaggccccccgcttgttagccacttctgtcaccttctggtggagccctcagaacataacctggccantgcccgncagcttnaccttct

SEQ ID NO: 530 - DNA, 750 bp, Homo sapiens
  "n" may be a, t, c, g, other or unknown
gaaattcaggttaacgccattgataaagggattccttccatggcaggtcacagcatggtcctggtggaaattctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgcttgcaacccgctagaccacgangagctggagcttgcttgcagtttccaggtgagccgccgccgccgacgcccnggcgttgccggccttttggggcaagnaaaccgtggacgcttgcaaggtggttncgtggcttgggacc

SEQ ID NO: 531 - DNA, 775 bp, Homo sapiens
  "n" may be a, t, c, g, other or unknown
acatcctccggctgcccgcgcacctctccacgccggccccgttccgcggctcgccctcggctgcgctcggctcccgcgggcgctcggccccgagcccctcctccccctacccgccggccggacagggaggagccaatggctgggcctgccatccacaccgctcccatgctgttcctcgtcctcctgctgcccctggagctgagcctggcaggcgcccttgcacctgggacccctgcccggaacttccctgagaatcacattgacctcccaggcccagcgctgtggacgcctcaggccagccaccaccgccggcggggcccgggcaagaaggagtggggcccaggcctgcccagccaggcccaggatggggctgtggtcaccgncaccaggcaggcctccaggctgccagaggctgaggggctgctgcctgagcagagtcctgcaggcctgctgcaggacaaggacctgctcctgggactggcattgccctaccccgagaaggagaaccgacctccaggttgggagaggaccaggaaacgcagcagggagcacaagagacgcagggacaggttgaggctgcaccaaggccgagccttggtccgaggtcccagcttcctgatgaagaaggcagagctcttcgaagcccaagtgctggatgcagccatggaggaatcctcaccagcctggcgcccacatgttctttctcacacctttgangcagcacctgcacagaagagtccctgatccttgnccgtaacttccttgnggcccaaca

SEQ ID NO: 532 - DNA, 682 bp, Homo sapiens
  "n" may be a, t, c, g, other or unknown
ctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactnccttcacagctggctgggcatcaccactgncttcctcttcgcctgccantggttcctgggctttgctgtcttcct

SEQ ID NO: 533 - DNA, 744 bp, Homo sapiens
  "n" may be a, t, c, g, other or unknown
gttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcangaagtggatgagttccacctcattttagagtatcaagcangggaagagtggggccaagttaaaaagcttcccatgccaacccgatttcatcttcttttnacgaanctttttc

SEQ ID NO: 534 - DNA, 877 bp, Homo sapiens
  "n" may be a, t, c, g, other or unknown
gcacatgcgccttgagggaagatggcacctgccggctgctgctgctgctgctgcttctggggcggcgctgtggccgccgcgggcgccgcccggcgtgtcctgctgctgctgctgctgggggtcctgtccgcccggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcgagtcatcctttttgaacttccatgactcagactgcgaacccaagggatcatcaccctgtgactccttgctttccctcaacactgagaagattctgagccaggccaagtctattgcagaacagaagagattcccgtttgccactgataatgacagcacaaatgaagagttagctattgcttatgtcttgattggcagtggtctgtatgatgaagcaatacggcatttttcaacaatgcttcagattctgtcccctctgggacgaattaatgaagcagtgaatgacctcactaaagctatccaactgcagccctcagcacggctgtacagacatcggggaaccctgtacttcatatcagaggactatgcaacagcccatgaagactttcagcagtccttagaactgaacaaaaaccagcctatagctatgctatacaaagggttaactttcttttacagaggactttttgaaggaactattgaatccttcaaagaactttgaagcagaaaagttgactttattgatgcatataaaagtctanggcaggcatntngagaactgggcaattttaaacagcccttgaaac

SEQ ID NO: 535 - DNA, 811 bp, Homo sapiens
  "n" may be a, t, c, g, other or unknown
atgcgctcgcatcatggcggctgagtgggcttctcgtttctggctttgggctacgctgctgattcctgcggccgcggtctacgaagaccaagtgggcaagtttgattggagacagcaatatgttgggaaggtcaagtttgcctccttggaattttcccctggatccaagaagttggttgtagccacagagaagaatgtgattgcagcattaaattcccgaactggggagatctatgtgatcactgtgtccaatggaggccgaatcatgcgttcctgggagactaacatcgggggcctgaactgggagataaccctggacagtggcagtttccaggcacttgggctggttggcctgcaggagtctgtaaggtacatcgcagtcctgaagaagactacacttgccctccatcacctctccagtgggcacctcaagtgggtggaacatctcccagaaagtgacagcatccactaccagatggtgtattcttacggctctggggtggtgtgggccctcggagttgttcccttcagccatgtgaacattgtcaagtttaatgtggaagatggagagattgttcagcaggttagggtttcaactccgtggctgcagcacctgtctggagcctgtggtgtggtggatgaagcttgtcctggtgtgtcctgacccgagctcacgttcccttcaaactttggcttttggagacngaatgggaatttgagacagatcccactggaatctctcacttaanaatttggaaatggattccaaccccgggtcctggctacccagccaacccagnggacnctttcc

SEQ ID NO: 536 - DNA, 798 bp, Homo sapiens
  "n" may be a, t, c, g, other or unknown
ttctaataacgtcacgtcgataaggggcttaggattgcatctggcctgtgtaagccctctgagttctgcggttcttagagttcccttttcagcactatagctctgccttgttcccttgttcctccttctggcgccccgtgctgtgccccctgcaggagtccaagctgtccccatgctgcgttctggtccggccgcccctcccgtggtgtggccctggccgacccccctcctgcgccccgcttttctcgcagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagtcaggcccactcccaaaaacatcacggtggtggcgggcacaaacctggtgctgccctgccacctctcctccaacttgggccatgcccgctggacctttgggggccgggaactgcctgcggaacagccgggtccttcctctacaatgccggctccaagccctggttgttgatgggtgcccanccccgccatgccggggcctaacacttgcttttcaaaagaacaaggggggnccggctggntgcttaaaggtaccttgttgggtgttcttggcnaggcccntcggtgaacttggaaggccggggcccccctgnaaaaac

SEQ ID NO: 537 - DNA, 721 bp, Homo sapiens
  "n" may be a, t, c, g, other or unknown
atagaaggaagaggagcgaacatggcagcgcgttggcggttttggtgtgtctctgtgaccatggtggtggcgctgctcatcgtttgcgacgttccctcagcctctgccaaaagaaagaaggagatggtgttatctgaaaaggttagtcagctgatggaatggactaacaaaagacctgtaataagaatgaatggagacaagttccgtcgccttgtgaaagccccaccgagaaattactccgttatcgtcatgttcactgctctccaactgcatagacagtgtgtcgtttgcaagcaagctgatgaagaattccagatcctggcaaactcctggcgatactccagtgcattcaccaacaggatattttttgccatggtggattttgatgaaggctctgatgtntttcanatgctaaacatgaattcagctccaactttcatcaactttcctgcaaaagggaaacccaaacngggtgatacatntganttacaggtgcggggtttttcanctgancaaattgcccggtggatcgccgacagaaactgatgtccatattagagtgattagacccccaaattatgctngtcccttatnttgggattgcttttggctgttattgggtggacttgtntttcttccaaaaaattaatatggaatttctcctttaataaaactgggatnggctttcgccnctttgtgttttgtgcntgctatnaaatct

SEQ ID NO: 538 - DNA, 746 bp, Homo sapiens
  "n" may be a, t, c, g, other or unknown
acactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggaggagtttgaagacattgtgggagactggtacttccaccatcaggagcagcccctacaaaattttctctgtgaaggtcatgtgctcccagctgctgaaactgcatgtctacaggaaacttggactggaaaggagatcacagatggggaagagaaaacagaaggggaggaagagcaggangaggaaggaggaagangaggaagangaaa

SEQ ID NO: 539 - DNA, 740 bp, Homo sapiens
  "n" may be a, t, c, g, other or unknown
tcttccgggcgccgcagcttcctgccaagcaccgcgcagccgcctccgccgcaggatcccccggtgcaggcctccgtgctggtgcggatcctggagctcagccgcgcgcgccctgcccgatcctgtgccgacccaccgcactatgcgcgccgtgccgctgcccgccccgctcctgccgctgctgctgctcgcgctcctggccgctcccaccgcccgcgccagcagagccgagtccgtctccgcgccgcggcccgaacccgagcgcgagtcgcggccaccgcccggcccggggcccgggaacaccacccggtttgggtctggggcggcgggcggcagcggcagctccaacagcagcggcgacgccttggtgacccgcatttccatcctcctccgcgacctacccaccctcaaggcagccgtgatcgtggcgttcgcctttaccaccctcctcatcgcctgcctgctgctgcgcgtcttcaggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttccagcctggtggcatcctgtggaaaagttggncaagcttgcaacctggggtgtgaaaggacttggacctggaagcccttcttgcgttcggangtgtttgaaaccaaaacgnaacg

SEQ ID NO: 540 - DNA, 692 bp, Homo sapiens
  "n" may be a, t, c, g, other or unknown
acgggtgctgcgcctagctgcgcaccatggccgggttgctggcgttgctgggtccggcaggcagggtgggcgcccgggtccggcctcgcgccacctggctcctgggcgccaccgccccctgcgccccgccgcccctggccctggccctgctcccgcccaggctagacgcccggctgctccgcacggcgcgcggggactgccgcggccaccaggaccccagccaggccacggggacaacaggcagcagcgtcagctgcacagaggagaaaaagcaaagcaagtcacagcaactgaaaaagatttttcaagagtatggcactgttggcgtgtcattgcacattggaatctcattaatttccttgggcatattttacatggttgtgtcaagtggtgtggacatgcctgcaatcctgctgaaactcggatttaaagagtccctggtacagtcaaaaatggcagcaggcacaagtaccttcgtggtggcctatgcaatccacaagctgtttgcgccagtgagaatcagcattacgctagtctctgtgcccttgattgtcagatattttcgaaaagtgggattttttaaacctccagctgcaaaaccttaatgaactcttcagtcgtacacactgaaaacctatttcttctaaattacatgatttggattggntttangggttttaagggttnagggg

SEQ ID NO: 541 - DNA, 381 bp, Homo sapiens
  "n" may be a, t, c, g, other or unknown
gtgatcaaagatgtttatttaaatgcagattttacaacctcaacttgtccctttacaacaggtcttcccagagcttttaatgtgcagacaggcatgtgaacctctgataaagagagggaaaatggagaggcatcttcctctgacttaatacaaccctttttacttttggtagaaaatcataaggcatgagtgtttaaggagcacactttgggaaatgtggttctactanccttactaggcaaatatgcttctaatatgtataactaacacatgtnaagcactaattatattaataatgccatgagtccttttttctttttctgtctacttctatgatagtttaataccatgctttcttttattatcactaaaaagatggac

SEQ ID NO: 542 - DNA, 385 bp, Homo sapiens
  "n" may be a, t, c, g, other or unknown
agatatgtaaaatctttattgtttcatcatcaaaagttttctttccatagaaagaatggtaatgttgtatcagtgcatattctatggaaaattcatatctcaagtaactagcctagaaatcagagacagcactatgtcnagctagtatacaaggtcaaagacacaatgctgccaatgcaattagtatatagaaataatacgcagctgttagaaaaagtctgtggccaagtggataaaacagtaacagtgcactgcactgacatccanaacagaaaatngggaaggaccaganaatgcncttcctgcaaaaaaaaagtccagtagatcncaagcacaaagagttcccaactgtctcaccagctctctaactcatgtgtncctgcac

SEQ ID NO: 543 - DNA, 512 bp, Homo sapiens
  "n" may be a, t, c, g, other or unknown
gatttctgaaacattctttgtttaatcatataattattttcatctnccagtcatcataaataatccactttatgacttaaccaatccttttgaaaaaatttggtatttagcacaaacactgaacattagctagaggtgtgttaatttttaacagaatagggaaaaattttaaaaaacccacaaaaattttaatactaagaaaaaacatgaaaataccaacattattacccattaaaaaatctaattttgttacaaccattaaaaaaaatcccaggtgggaaaaatgagtaaacataaatataatctaatgtntttctttcataaatacatttagacaaaacaaatgcataaaacagatagctttacagtgttntaaacataacaaaatattttaagctctgaataattaaatcccaataagcatgnaattaaaaataaatttggatttnatttttngtnctttatgaaaaaatttgcccaaggaatttgtgtttaaaaaaaanaaattaggc

SEQ ID NO: 544 - DNA, 408 bp, Homo sapiens
  "n" may be a, t, c, g, other or unknown
aggacaacgtttgtttgtttttattttaaaaagtcaccatattaataaaaatgctacaaaacccaaaataaatatcttcaagttacaaaagcaaaacaggtctanaaaagttggctgtaaaaaggcaacagagaggacagacccaaaagataaatgtctgcttgcttgggtggggctggtgctcaagganggacagttgttggccctctcccccgaccatgccttaaaancatctccgccaggccagtgaatcaggcctgggtgataacggaaaaagttccatgcctgcaggcatcgttctgccatcactcaccgancttcctggtctgtgttccccttcccagcctcactgttacccgtaaaaatgangaacccagccgggtgaantaagaanagcttggcttcana

SEQ ID NO: 545 - DNA, 260 bp, Homo sapiens
  "n" may be a, t, c, g, other or unknown
ggtgtacatctgatttactgaattttaaagtctgggatgttagtggggaaaaggcgaggtgagcattgcgtgacgccgaggactangcggggcggggactgcacctggctaggcacccccaccctgggcaacttgcccacggaccccagggcagtgagtattgacaggaggtancccggggtgagacctctcacagcaagaaaatggtgtggttgctggggcctccctgnanagtgtcntccctgcggcccctgggaant

SEQ ID NO: 546 - DNA, 496 bp, Homo sapiens
  "n" may be a, t, c, g, other or unknown
gagatagagtctcactctgtcacccaggcgggagtgcagtagcacgacctcagctcactgcaaccttcatctcccgggttcaagtgattctcctgcctcagcctcccaagtagctgggattacaggcatgcgccatcacacccagctaattttcgtatttttagtananatggggtttcaccatgttggccagattggtcttgaactcctgacctcaagtgatacacccacctcagcctcccaaagggctgggattacaggtgtgagccaccgtgcccggcacaacctttctttgttatgaacactgtgtctgctgtgagatatgctgcagggccgccctaatcacagaaagcaatggatagaaacatctgacttttgcatagaaaaaaaaaaaagcnaaatgtgggaaanangatcccactantcttgctgcactgtcactgggaaatcactcangggaacatctctttccttcccaaaacgctggaagaaatcc

SEQ ID NO: 547 - DNA, 248 bp, Homo sapiens
  "n" may be a, t, c, g, other or unknown
ctcaatcaacaagtgtttattgatcacctactgtgtgcctggcactgttacagatagtctgggggatacagagaggtctaggatatggcccccacccaccgaagggtttacaatatacttgtgagatcggacacacacacacaaataacgatcaatcaaaaattgtgaatgctaagcatcaagaagcaatttatacattgagggttggggganggaggggtnnganagggatggggtgatcaccanaa

SEQ ID NO: 548 - DNA, 275 bp, Homo sapiens
  "n" may be a, t, c, g, other or unknown
ccaaaaacagcattttctttgtgcaaataaaaacgtgtgtatcaagtatgatgttcccccaacgtggacacactcagttcctcacaaagccaagcccgctgcagctgccacatccctgggcttacggtgcagcaggtgcttttttcaagacaggaatcaaaatgttaggaacacggcanaaaggggacacctggagaccaaacgcangatgaggaatctgcanaggtccagggaatccagaacagtaataccctancangggcatggggcgtgaa

SEQ ID NO: 549 - DNA, 532 bp, Homo sapiens
  "n" may be a, t, c, g, other or unknown
aaactcagtaattcctttattttgattttaaattaatcacaaccatcgaagtggtaagaaacagctgacaggtgtacttaaaaatactgaattgacagctacattgaatgcagggtttcccagggtagttcttattttgtcacttactccaattacattcaaggtcgttatgcctcatctttttcctgagctgtggcagctctaactggggcacccanagagatacataccaggtaatctccacttctacttttctggtagcttggccctggcaaaatgagccccacaatctanaaagtaggatgctaaacaaagttgaatcaacatatctttttagaaaatatcaggttagagaatactcctgangacctgtttctaaccaganttgacaaatgtgaaaaatgcatcactanacacagtccttgttaaacacacccggaactgcaattcaagaaaatgggttctngggccgncctccccngttacccaaaacctttttcccaaaaccacttctgaatncccccttnttggg

SEQ ID NO: 550 - DNA, 280 bp, Homo sapiens
  "n" may be a, t, c, g, other or unknown
gagctgtcaagagaactttattcattggaaactgggccggagaccctcacgaagctgcaagcccctgggccctgggcccttctgtatttgaaccctagtgaaatgtgcacagtctgccctctccatgccaggggagagacagagaggaatgccntttttctgtgtgatgtgggagtgacaggggaaagancagaaatccggttatccctcctganactcccnctgagctggggtgccacagggcacgtggccccaaantcaggtncaaatgcatcccccc

SEQ ID NO: 551 - DNA, 587 bp, Homo sapiens
  "n" may be a, t, c, g, other or unknown
aacacaaaatttgaattaactttatttcccctacagtcaacaacttctctgcattgaattttaaagcaacaaagtaaaataaaatcccccaaatgacaaggtatcagaaatccaaacttcgttacactctatttgtgaaaatgttcagccattttattgttctgtaaaggaaccatcatctgggtcaaaaatgaattctataaatcaaagaatattctacaccttggaaaaaaaaatcagcagtaacattctcactgaatattgtaaattacatttttcttcataaaaggtacatactattctgcacttttccaccaaaagcagtggtgtgttatgcttgttatataaaaaaaagttatatcctgtggcaggaaaaaccctttctctttcacttttactaaacaactggagaaaatgttcaagtctgtataaagttgcctataagctgggaaagtgaactgttcaatctccatttacattttagtgcatttttgacaattgtcccttttttaacaaaagttagaaaatgcttttncccttaaaaaatgtttccccccaatgcttnaggggattaaaaaatttggaaa

SEQ ID NO: 552 - DNA, 437 bp, Homo sapiens
  "n" may be a, t, c, g, other or unknown
ccaatcaaatttctttttaatgaaaactaatttttaagggcaanataccacagcaaaaaaaaaacgtcttgcaaaaaaaaacttcatggtttacaacnatcaaatgtatgggctatttgcctgattggtggcctgnactcancaanaaattcctttgcagcanaggttggccacacatctggggggtgcaacaccactgaaaaaacagctttctaagcattantgtnaggcaaaaagcaaantgcctaaacttggccatttccaccaanaaaaaaagtttcatagcaaccttccttcaccanaaaggcttactttatgatatgctaacagaacanaaaagcaggttgggacaanatacanantttgttgcatttanctatgaccttctctccctctgtggattttggcagggtngggaaaagcaggaaaaagccntn

SEQ ID NO: 553 - DNA, 588 bp, Homo sapiens
  "n" may be a, t, c, g, other or unknown
ggaatcatcattaactttatttgtcactcttgatanacattggtccactccaacataaaaagtagaattcacccacttccacttaatattctatagaatgaagttgtaccacaaaccatagtaacttacacagggggaaaagttactgaaataaaaatgttttatattcatgcctcaaaatgtccctcagggatttttgtgtgtataatgaaaagcatctatatactccacaaggctagtttcttcttagatcaatgtagtatttttagtatccatattagcccatgtaggtcaacaaacttgcagaagagggttaaaaaacagttgtcctctgttactcagatacagttccaaaactaagcgattatataagcacatccatattttagggctactctaagttaaaaacctttnctcttgtttcagagttatttacatcaaattaagacatttacaaattgttcatagtatacaatagcccaaatatgaatttccacctatgctgtgtaaanaattnaaccatccgtaatttgtctaataaatccatgcactttttccctaaacaaactatcccaaanttttactttc

SEQ ID NO: 554 - DNA, 594 bp, Homo sapiens
  "n" may be a, t, c, g, other or unknown
gaggttggggagagataacgctgtaaacttttatttttcaggaaatctggaaacctacagtctccatgcctgctcagccaagaaggagctcactgtgggcaccagagacagggacccaatgtggagacctgtgagcctgtgtccggccctgaactctcaagcacagggcaggcttcctgagcattgaagagaatatgtgggagaacaaaacagaaactgaaagaatatgcaaggtgtctttcttggatgttattccatgatagatagtaggggcaggagtgagagaggctgactaggtctggacatggaggctggaagagtcagggtgtgattcggagaggcgcatgagaaggaaggtggattttaaggctggaaatctgagggtcagtggtccaagtcactcagagacagaatcacagcatagcccttgctgatggcaaacaaaggaggacaagaggactggaaagaattctgctagcaggcaggagctantaaggatgaatttgtancaaaattaccaagtggaaaggatgattttgggcatttttccggtcttcagaaaacnggagatacttnaaggctnnaaatggggct

SEQ ID NO: 555 - DNA, 585 bp, Homo sapiens
  "n" may be a, t, c, g, other or unknown
cttatgaacactatgtatttacacgtactctttcatggaaggaaaactgagatggggaagatctcagggcagagactccatattgcaacatggggatcatgcactccccacagattcagataaacttgaagaataagcagaaccaccccaaggactcagggcacatttgcccccaaccacctccagggctcttccttccggccaggctccaaccagaaagcaaagtcatagctatgccctgtgccccatccccaaaactaatgggcccaagatagggggccagggatgaaggtttacaggagttcagatgttagggggaagccctgatttgctgcagaaagcagttctgatttctcatgggaatcaggaatcaggcaaaggtctggccccaagcccatccaggctcagagagaacagatactaaaatccaagtaatcactcatactcaaagagaactcagaggctgggatggtcttccaggcccagttgacccccagcatctcagtggtcactccgttccagtgatcacttatacacttagtgggcatttgcccagctntaaatgggatgttttcatcacatggg

SEQ ID NO: 556 - DNA, 573 bp, Homo sapiens
  "n" may be a, t, c, g, other or unknown
aaacagagaacaaagggattcactcagagatcagaatacgaagcttcctctcagcatcatgggaggagataaaataattcattctatggtctttgttccattaagacttggtgctttcttcagtaacagtatgtgaaatgtggctgactttgagtcccccactgtgtaagtggaattatttttcactgcagcatttctgagtctttttcttgttccttactctgaactgtaaaattaagttcataaaggcatttggcaagggtggaggaagcttccatgttactaatggctagcactgataagttattttcatgtctctttaacaatctgcgaccacattctgaatatttaccaatattttttaatattaaggcagctgttagtcggatgtgtttagttattggtccctctttttcatctgtaaaatctcgaaagacaaggtttcttgatcctctcctcagagccataagtgcagcactgggatgattcacaatggncttttgtgctctaagagttgaancttggngcccctacagtngctgntttggaaaaagacttntgacttcctgcgng

SEQ ID NO: 557 - DNA, 591 bp, Homo sapiens
  "n" may be a, t, c, g, other or unknown
ccaatgccaaaaactggtgatttatagaaatcaccctggtttatttttttcaacaaaggaaaaaaaaaacatggttcaataattcagcatttgggactctggcaagtactgtctgcattgttcaaaataagtgttcctggctgtgagctctgcaacacatactgatggcccaggaaccttcttccatggttctaataaaacaaaggacccacacatggaggttacgtgagtcaacaaaagatgctctatcacaatgtgcgtaaaaagcaagtctttgaaaaatatccagatctctaaaggaatacaaacactcctatttggttttgtttttgttcatcttcagtattatattttagttgttgaggaaaattttttttactgtaaggaaggagttatatgactttataagtgggaaccaacaggctgccggctaatacatacgctttccctccaagcaagtagctttttccccccgaaagcctctttcatgatttcaatatgggtcaaaaaagtaaangaaaatggatttcaaggtnttcaattcctattaaaaaatgggtatcaaaaggtaatngagggacctaatttntt

SEQ ID NO: 558 - DNA, 531 bp, Homo sapiens
  "n" may be a, t, c, g, other or unknown
aaaacatcaagcaatgnttattgngcaattccaatcattatttgcagaatcttggtttanagtcagtctttatagccatttcaactgcttggtttaaacaaaaagcaacaatctggttatctacctataaatttcatggtntttctttaaacactgaagtactaaaagcnctgatgatttgtattataatttttaaaatatttaaaacctacacagatttcatagatcattccttttataaaataatcaaaataatttgattatctggaaaaaaaaattcttgaaacagagccctttccaggtatcttcaatctctgtaaaaccccaaaccccaaacagagtanatgatgaaataaggatttctcagttgcccaagactgtctgaaatttaaggttgataaatggactggcgtttttcatgtttcctgggaattcagagcttacangtggcatcagaacctcagatnntctnggatggntttacatggggtttactttgnatttggtcattttcatttgctttntttccaa

SEQ ID NO: 559 - DNA, 457 bp, Homo sapiens
  "n" may be a, t, c, g, other or unknown
gcccaaatttatttttattttgcacacataggaaacaggatcctatcagnnngagaacaaaaaagagaaacgagccaattgttgcagaggaaaagcatgcacagatctgcttcaagtttactctgaaccacggacgctccgggaattctacacaccaggagctgtctcactccaggaagtgggcacaacccaccatccacacaatggaaacaagaatggccaggaaatgtcaccgaagtgggacttccatatgcaggatcagcgttcacagtagcacaattctaaccaagttcaagggaaaacaaactctgtctcacacaaacatgggaatacaaaattgttgagccctagccatcactgnctcttacntaattgctatcaaaaagacaaacngaaattttagtnacgggacttttgggntgcctatttaagcttgancccgattcnagggggcaac

SEQ ID NO: 560 - DNA, 554 bp, Homo sapiens
  "n" may be a, t, c, g, other or unknown
aaatgagcaagtttgagagtctgcagtttggactaccatgagaattgataggaaggtgggagtcccaggcaatcccaggtcctgtagcagcagctggtggggttcccactccatgccgtgcagagcctgaactcaggatgacacctgcacctgctctctggctgggctctggcacaggaagccctcagcaaacacccccggcacagccatgccatagccagacaacagctcgctgtaccacaccatcatgggagacagcagttattctgagcatctcactgctgaagaaaccaaggctcagagaggaccatgcatgcacaaggtcccacagggacccaagaatccaccaagtgtcaagacaacttgcccatgctcttcacggagcaccttggaaccctccccgacaggcaccgctggctctctgacgtggcctgcaagtgcgtggagccccttcctcctcggccattcccagtttagattcccaggggaagcatcagatggnccttttcctgctggcagcanaacagacggaaccagccagaanccaaggcagt

SEQ ID NO: 561 - DNA, 541 bp, Homo sapiens
  "n" may be a, t, c, g, other or unknown
aatgaagtggttagaaaggtttattttgtgcttaggatatttttctaaggcatcacaagttacacatccaaactcttcaatggtacaatattttaaattctaaaggagagggctttaaagaaaacttgtatattacgatactgtaaatctaatggattcacacagcaacagagcctagaaagaaggggacattacagaaattgtctactacgcaatggtcagttgattcattgtatttatgattttcccccttcttttaaggtgaaaactatgtatcctagctctttaaggagtaaaaatacactaaaatgttccatcctactgacttttacctgtgaaatcccacacaatattaccagtcaggaaagaacacaggataatatgaagtttgncttttaaaaaatataaaaatgntattattttaaaacatcaagcattaccggactgnaaaatccattaaagaactttctggatatgaaggccaaaattcctttaagaccttttccagaagangctttttnctgagttnaatgcaacnttt

SEQ ID NO: 562 - DNA, 541 bp, Homo sapiens
  "n" may be a, t, c, g, other or unknown
ctcatacaaacattatgtatctttatttaaatttgcaaatgaaaacaacacatatttcatgttagttttaataaaanattccctatcctctgccccagtaaaacctaaccaagccagcctgacaggttatatcaatacaggganctggagtggganccaagggtggtgttanataggggtggggtacanatcaagggggcctgggaaactcagtgactggaagtctctgcccctcactcttggtgantagctaatttcagcagctggcttcataaggaagaatcaggggtgggtggaagctcctcccaattccanatccacttcctcttctccttctgtctcctgggacacttangtcttactganatggttttcccacantaaaaaaaagtgggggcanaatactaagggtcangaatgtgactctttcccatgactcaggcctctgtgctaaaagtgacccttatagaaaggaaaaaccccaatcctttaaccaatnantggtgggggtctcntnccaaaaaaccnctttaatctgggc

SEQ ID NO: 563 - DNA, 251 bp, Homo sapiens
  "n" may be a, t, c, g, other or unknown
aataaagcanaaatgtatttattaggcacccttgttcctcacagagggagcaagatccaggcctgagcgcctgggaagtctcttgaggttgcaggaatctccananaaacataggcgctgcccagccaccaccccganaacactatttggctggagtgtgaccgccgangtgatcctggcaggaggctggggttggctcctccactccncaaacactgangantgggtggggacacccntgacacccaccc

SEQ ID NO: 564 - DNA, 249 bp, Homo sapiens
  "n" may be a, t, c, g, other or unknown
atcaatactttggttttattttaaaacagtgaaaagaaaaataaatatctgaagaataagaatacanggctgggtgcagtggctcatgcctgcaatcccagcactttgggaggcggaggcangtggaccgcttgagcccacgagttcgagaccagcctgggcnacacagtgagacccccctctttacaaaaaatacaaaaattanccacgtgtggtggtgcacctgtantcttgagtgggggcgccaca

SEQ ID NO: 565 - DNA, 504 bp, Homo sapiens
  "n" may be a, t, c, g, other or unknown
cagtgtcaggactagtatattttattttcagatgcaagcagcaactttggcatttcttatcacaaaaaaactatatgagaaagctggcaagcccagtgaacttcctggccgganangtttttccattaaaggtggcaaggtttgatcatccaccatctttagagttagaccattgagttggacagatttggaaagtaatccatgaggtcccaaaggtcttaaaaggtatttatccacttgcttgttaaaaaaaggatagggtaaccgcaagtacttggtgacattatggaggtttatggcatacanagttaaatctccttctttataccttggattgtcagtgtttgtgcaatgaaagtatactccaancttccttctctttgaaccttgcacgcttgccattaacaccttggtgcccccaatttcttgaacanaaaaaatacccntaatccgttaangatccaaattttccccnctaaattggtngtttcccgctcccaaaaa

SEQ ID NO: 566 - DNA, 536 bp, Homo sapiens
  "n" may be a, t, c, g, other or unknown
gcctgtaatttaaactttatttcatatctattgttaaattacacaaaatcagtggaatggtttgtaaagctacaccaatggacagatgtttacagttgaaatcatgggatttacataatggcaaaaatgtatatgtatatttataacatcctctatatacaataatcagtatanacagagaaaatgcacttaatctttgcaaatcatgcacaccacagcaataacacaaaatgttttttctgtaacaagcttttccactggctcaggcttcatcctgctttccaacaaaacctatcagttttaannagcaaacattttcaattaaaactaaagaaaattgaaataccatagtgatctactaactattttaaaaacacaattgtncacaaaatagttttactctaaaacactgtgacttcaaggtntggaaaaattcctttcagtttttagctctcangatttcaagactgcaatactgtcagacaaaacaaaactagaaatactgatccagccngantccanaaaatctnttttaa

SEQ ID NO: 567 - DNA, 571 bp, Homo sapiens
  "n" may be a, t, c, g, other or unknown
gatcattgatagaactatggctccttaactcagaagggcccttttttctcaaaacaacctctgcaagatgtaaccttgacttcccaggaaaatgaaaggtagttaacaatttcccccatcacctatgtnactccctaaataaataaaaattacaggcagttgctcctggagattacatattatggtgttgatgacaatcttttagaanacgttaaactttttagtttgtcagatttaaaaaatgaaacattacagaaagttcaggaacaacacacttaagttgcatgaacatccatgtcagantctgggangaaagggggcaacagtgttgtnaataagaagctcgtanatttttctcatcttatgaacttgttttcagtaagatgttctctttgttctgacacctctcgccaactccaatgcccnaagatcaaggaacagatcaggatgtcttgcttcctttaatcccatggaaccgtncagaaaaatgacccnaatgctgatctctcccctgatggtnccancttnactggcaaatctcccatccctactccatttggaccttccaaat

SEQ ID NO: 568 - DNA, 554 bp, Homo sapiens
  "n" may be a, t, c, g, other or unknown
ggacaaaacaatttttttttaatctgtcttgtaaaatccttacttccttttgagtctctgatggccacaacatttcatttganatgtttggcagtcacagcttcaggggttatggttactgattatctaaaccccttaggtcagaatgaacaaacacagttcatgtaaacctggctgttattggagtcctctgaccaaganataatagtgaanagtgtggagagcctgaatgcccatggtggaaatgctggaaaaattaaaggtaagaaataaaacatagcacaggagattcagagggctgggatgacttctgagctgctctctatacccaaggccctttcaatttctanctgtgaaaaattttncatgcactgtggtgcctgatnttcctgcaatttgacaaaaataantactttacccaanaaaaaggatgccaggctnctactttaccctttggggatgcncaggaaccaaggcncctgcttggcttccatttcncagggcccgccaccttttccctggaangttctaattangaattgggaatggncncc

SEQ ID NO: 569 - DNA, 505 bp, Homo sapiens
  "n" may be a, t, c, g, other or unknown
gcaatgaaaaccctttaatgttgggctttctttaaataaaacagaaaggttgcagctttcccatggtggctgtaaggcaagaacagcagtgagggcgggccgtgttctatcgggcagtgctgcagcccttgactctggctcaaggtgggcttcctggaggcagcggcaaggaggcagttctggatgtgcaggcacagatgtaggggaacaggcaagcgggcacagggccctgagctgacaagcagtgacccctgcacccagctagatggggcaccccctctctgggagctgagggcatcagctggagcctcaggctgggaccagccccaactttgccttggtgactctgggccattccaggcctcagtttccccagctgtaaggtgaggcattaggcaggaaggggtggccccagccagtgtcctagtaacctggngtctccattagggagacctgagaagctgccanganaagctntgctacccaangnaaggcccggccaana

SEQ ID NO: 570 - DNA, 588 bp, Homo sapiens
  "n" may be a, t, c, g, other or unknown
acatacacacacatttatatatataatggaaaaacatatatatagttgcccctccacatccgtgggctctgcatccacagattcaacaatggatgggaggaaggtggggaggaagggaaaaagaaagagaaccagggtgcaaatcaaatagaacaatgataaggccaggtggctgccagtttgtgactcttgctttatgtcaacttcttagtttctgtcttttcccagcaattcaagatgtgtttaagaacttaattcaaggtgtacttggaagtagatcaaatgcaggtagaatttccattgccttgccacttctttaaatctaaccatacagtttttattgagcacctaacatacacacacagtctctcattacatcacactaaaaatgaaatatattaataattagttcatgaaacagagagatataacttccataatggtcaaaaatgactctgagatcttacttacattttanctgtttaaaaaaaannaatcagatttaaggagaaatactgtttactggaacacttaacatntataatncttntaaatgcnaaaaggttatgggaaagttcctaacattgn

SEQ ID NO: 571 - DNA, 578 bp, Homo sapiens
  "n" may be a, t, c, g, other or unknown
gtgttttttttttttttattaataccacatcaatttgaaattttacaggaaccaagattcaagctccttaggtgctactgtatttttatgttgcacgcacagacacgtacacacagtttcattagtaatttttcatctataggtttttcttaaaaaaaaaaaaaatcctgtgtggcacaaagatctcttcaattatctaaacacagcagcaacaaaagaaaagaactggatgtggcacttccactgcanaaggtcctttggaggggaagcccaaaaagacaatcactgacttcctgggagggcagaggatgaggatggagaatgcacttcctactaggacatgaaaccagttaaaacactcaaagggggctaagaaaataagatggagtaaggcaagggtaccttttacccatccaaattcctaactaatttttccaagacacgtagacaatttccttcctactttttgcacttgccgtactttgggaccatcaaatatcataagcccttacttttaactcgnccgtgcatattnccttntggaaggatcatgactttgagtgganaancctgaagga

SEQ ID NO: 572 - DNA, 521 bp, Homo sapiens
  "n" may be a, t, c, g, other or unknown
cacagcaaacggagtggaggcctgtatttcacacctgctcactcactccatggcttanaaaagaacacgtccaccgcggaggccgcaatgcccacctagagcaggtcgtanaagtagtccaggccctggcccagctcccagatagagaccccaacgcccagctcccgggccagctccagccgcacctgcagggacttcagggttgggtagaagacgacgtgcctcccactgcggctcttcttgtactcgaanaagtgctctgaggcctggctgtcccacaccatccggggcctgtggtccttcagtgtctggatgtacctggccccgacaacaggctcacgggcatccttggaggtcgcgtagtccataccatagaagttgagccccaggaggattttgcttcgccacttggacttcgggtccaggacctggacgcaggctcgaacccaggacaggggtgcattagggccaggctgatgccctgtaaantaatccnanggcatgangntnaaaccntttca

SEQ ID NO: 573 - DNA, 539 bp, Homo sapiens
  "n" may be a, t, c, g, other or unknown
gaatgaaaagggcttttactttctttttaaaacaagtgatttttaagggtttgtagaaaaagcaaagaaaagcataattctcctcttacttcaagctagtgtccgatgagaaagtaccaggctaacctctgaagaatcctaccccaacaccttcttctttcttctgctgggatgaacatctaggggtaagatatgactgctctctaccatctggggacttctcttctttatattgttgcattcctcaatctttgcataaggaagagaatggctaattcctctaggtgccaaggaagagcttccctcttcctacagcctcgcatgtttcttttcccactggttgccaggaagcttggagatatggtgacgactattcaggcacacatctcttccttgggtcctaccacagtcatctcctccaatatgcagtgatgttgacaggcttggagatggtgactagggagttctgaactangnacctcaaatctatcaagtccncagttaccnggacttgancattcttagggttcngnacctcc

SEQ ID NO: 574 - DNA, 596 bp, Homo sapiens
  "n" may be a, t, c, g, other or unknown
cttttttcagaacattcacctttaattctgttacaggttccagtatttgcgctggccctagtcagctgtgggtaagagtcacccatgggcaagagtggggaggggactgctcccccatgaaccacatcctcagtgttggccaaataccagcgtgttgggtaggcttcctgtgtccaccaggcctggccatgtcctgcacagtatagcttggacctctgggcctgaaccagggtgagcatcaaggcccccatttctcctcaccacggggtcgcttgtcagctccaggagccagtctggccccactgagaacttttcagtcgagggcctgatgagtcttgggaatgcgcttctgcaagagggcccaggctttctccacctggcgttgggtgatatgcggctcccacaaggtgctgagcaccacgtggctctgttccacaagctgctgcccgctcatctggctctgcagcccggctttgagcccgcggcttcactgaggccatccctcttcacaatgcgtcttacagcctcagtctctgggatgacaagcagtccacaccttatggaccaaggttttggcaacccgntttagcnacaaa

SEQ ID NO: 575 - DNA, 430 bp, Homo sapiens
  "n" may be a, t, c, g, other or unknown
caaaagggagcagaggaacaaacaaggaggaaagggcgccacacacagcccagaccaggcaggagcggcccagccgccggaagagacgttccttgcaaggcagggcccctgctggacagcacgccccctgggcgacagggtcagggaccccaggactgcacagctgcagacttgctgggaacctgggacaggtgacacgcccactctcgcctgtggcccagggccttccacctctgcatccagccatgcacccaccatttccccacagggtacaggggcagccttccttgatccacagccaacccttctcctgctgtctctggctgtcagtgagacccctctggaaagggcagaagcaggcaagccaggcagaagggggcccggggtcccactacctgggtaggaatgagcagagggcgggcannnnnnn

SEQ ID NO: 576 - DNA, 586 bp, Homo sapiens
  "n" may be a, t, c, g, other or unknown
gagatttcaatacaatctatattatctcatatatagatttcttcctcactttatttgctcacttctgtcacgcatttaaaatgtcacagagaccaaaatagagtggctttctggtggaactcatggcagtcatacaacaagatacaaaactaggagactctgtcttctcatacatcatacaattaatttttcaagtattctttatgtacaaagagctactctacctggaaagaaaatttaaaaaaaaaaagacaaggtaggttatgcatcctaaggaggaggaggggatggagcggtcgggcacatgttcccgtccccacgaccccacggaccgctgattccctgccactgagctccccccaccctccacgcaaacagcaacgctgggcaggcgaaaaccaagggagtgggaatcagcagcactttggcctggagggagaagggaacccccggtggaaagacagcttggtgaaagccagatggcgggcanggccaaggcttggncttaacctgngttgnaccaccttnccggcagnttggnccaactggttcggccccccaaaatggagggggaaactggccttgg

SEQ ID NO: 577 - DNA, 535 bp, Homo sapiens
  "n" may be a, t, c, g, other or unknown
aaaaaaaaccatgaatcatttattctttggttgtctacacagacacttaagtactgtatcgctgttatgcagcggcctgtggaggcccctgggggtggctgggcctgtgtcctgagccctcagccagatccagggggtgcggtgtctggtcatgtccactccaagagcagtagcaccatgtanaaggctgtgagcagggtcccctcggctgagtggcagatgtaggctcactgctctgcagccccgaggggctggccagctcanagtgcagaanagttcctctccatgggtctagtcacccatccgtctgacctggacgctgtcatagctcatccttgggcttcgattcactgcctgagagagactcttgtgcaggttcgggggggccctgctgggcatccaagggctgctnctggganaagtccatctcttctgggctgaaaacattttaccangtcatntggctgcaccctgtnccgctccttgtgtcaaggtccagggtgaacccanggcnatgnacaacgctngcccctgg

SEQ ID NO: 578 - DNA, 607 bp, Homo sapiens
  "n" may be a, t, c, g, other or unknown
acacattaaaaactttattgtaagtatcaacatctaaatttgcatcaatttgatacatcgttgctcattttgcagaacataacagttgcacattgcaagagtcaacttgcttcgggtcttttcatgctcatggcggtccacccctgccttccctctccctgacctgcatcctgtcctccacagtctgccctgcctcctgtcgccacaggttgaagacccaagccctgaggagaacctgctgccanggggctggctggctgcganccanganggccaggcagttagccctgccacanggaggggcaggcaagggatcgtttctcctcttcctgggctgagcccgtgccaggccagccacagantgccctaatcagcccatgtggctccaggaaacctgctgttgttctactccatcccatttcaccgcagcctaattgctaactcccggatactcttaaccaaaattaacccaanttccatgggaaaaatccaaaaccttgaaccattgcattggttttccccattccttgtttctaaaatttttgaaaaaggtnctgccaaatccnctggctgnaaaaatttgggggaaaaatcacnnccnntttcc

SEQ ID NO: 579 - DNA, 519 bp, Homo sapiens
  "n" may be a, t, c, g, other or unknown
gcagcggtctgccttcatcttttaatggccggtgcggtacagttagtggacagacgggggatgggacacagcaggggtgaaacagggcagtcacagccggggccggggatctggaagcgggggcggtcctccccctggaaacaccgtctctggaaggacacccttaggatcccctgacctcagggtgccacccacacgggcctggtgttctgggaggcccgggctggagtgacccccagcccctccctacgttccagggacccttgggtctgtcgagtcccttgctggatgagggtcaagacctaggtcaagctgacttcaaccagggtgtgggggcccggcttcgtaacccccaaacttacctnccctcttctatccgggccangaaggcaatgggagggctccctaatcangcacagccccctgacctgtggcatcgtgtgggtgttttggggaggtcctgactgcccanctgggattactgntgnggtttccaaagcttatgcaaaccgangcggn

SEQ ID NO: 580 - DNA, 338 bp, Homo sapiens
  "n" may be a, t, c, g, other or unknown
gtgattatacgttttattanactcgggangggtatggcagggcttcatcagtgttccttcaaattaaaaaaaaaatacaaaagctacgtanaaaacgtcagatcagacnactaaactttcccgactcagggccaagttcttcttgagcctgcgctctcgggacgcctgcgaatcggtctccnaatacgggggcggcgcgggcgggtaataagcctcttcctcctcctccttgtggggtctcctcctctcctccgancccttcttcctcacagcctcctccantatccgcccatcatangggangtccccggacctggaaccnttgtccccaaggtccc

SEQ ID NO: 581 - DNA, 480 bp, Homo sapiens
  "n" may be a, t, c, g, other or unknown
catattcagccagtgtttattaagagcctactacacgccagacactttacatgctgatcacatttactcctcacaaccatcttgttaggganacatcatcagtgccatttgaacaaatgaaaaactgaggctcaganagattcaataccttatccaaagctctccagacaataagtgcaaaaacaaggatttgaattcaggactgtttgattccaaatctggaactttctggaacctctgacacacacacacacacacacacacacacacacacacacagcaccatgtcctgagctgctgcctcctggactcccgccagactgcacctgacagacaaagccaactangagggaggggagtgagggganaagtcccacaggtgaccaatgcctggccccttcatgacancaggggctaaggctgtcccccnnggactaaaaaaaagttttgaaaggcgggaatttccccttatnccccncc

SEQ ID NO: 582 - DNA, 377 bp, Homo sapiens
  "n" may be a, t, c, g, other or unknown
cagacaattcagcctttattttagaaaataattctgtagcttccactttctttcatgaaactgaggtcaggcaagaaacaaaaatccaccaagtcctctccatcctgccatggcgtcctggcctgtgangacatggggcgcctgggaacgggcggggaagctgggcancactgggccaaaagcgtcctggtcactgctccacctggtcactgctccacctcatgctganaggancctgtgtgtcaaaccccaggggaaaaagggacaggcagatcgaattctgtcttctaccaagccagcaggagcctcctaaancaacagggagggcactgattttcanaaaggangggtcagggcatantccctctctgangtaa

SEQ ID NO: 583 - DNA, 593 bp, Homo sapiens
  "n" may be a, t, c, g, other or unknown
catgaaaaaaataacaacaaaatgtatttaaaaacagacttctccagttggnattttgaatgaaattgctaacaactccaaccctctatattgtgtttcttttgctcctggaatcctcttggagctttaattcttgaaactcaggggggcagcaccagaaattaaatccccaaaggggaaaagtattagtaaaccttttggctggtcattcttttccgaaatgcaaatgggacaaattcttaagccctcttattcatttcatgatgatcattagataaaaaaattaagcctaacttgcatattgaaaataaaaacaaaaacacacacaaaaaaaccttgcagataataaatatcgcttattcacttattttaaacaaagtccaattttattcactctcaatatccttgcagtccattgtataccttctgcactgaccttgtttcagtaactgtttgatancttctctcgctcctctgttactggtcctttggaaaatcccatcaaaantgattatcaaaaaacccttgatattgttgttntcnaattngggaaccctccccttcctccatactccctcctggccggtgattta

SEQ ID NO: 584 - DNA, 451 bp, Homo sapiens
  "n" may be a, t, c, g, other or unknown
caaggataatttttattgatgaaaaaaatcttgcagatatgaaaagataatttttttattcctatgacattttctgtttttacgattttcttttcagcaatgaaaacctctgatgttctcttttaggaaggtagtttatccaacataaggatcccatccttttccataaatgaatcgattaatcatgtcaaaagctctcagaggctggtcatagggtaaaatatgtcctccacctcgaataattacctgatggaagtcacccacttgccggatgtaaccagccacttcactgtcagatttaaagatcttccaaacttttttttctgccttcttgtattcctggggatcctttccagtccatgcccatcaaggaacgctctgtcagggcagctgccacaanaatgtccanttgggcattgtaaatcaaaaccttataattattcntgaattc

SEQ ID NO: 585 - DNA, 359 bp, Homo sapiens
  "n" may be a, t, c, g, other or unknown
cctgaataattttttattttgtgcagaagnaggatccaaaaatcccgggntcaagtgatcctcccactttggtctcccaatgtgctanaattacagccctgagccacggccccatgccccgtttttaccagtgtatattttctactggaaaatgagacttttagggatgaatgtggacttgtctgttgaaacttgtaaatttgcttaaaaaaaaaaaaaaatctccaagtcttcacaaaattttatattccccaaggctgccccatcacaatgcctgtgaancttgactggcaaacactgaggcctgaanctgggggctacaaggggtcnctggctcacccggtccccccgtaatctgt

SEQ ID NO: 586 - DNA, 413 bp, Homo sapiens
  "n" may be a, t, c, g, other or unknown
gaggtgacagcaccgttttattcatgacaatctgcaaaaaaacaggtggatgggtcagaaagtcactgcaagcctacattcaggggctccacccgcagccaaagcccgccctcggcgcgcatgatcaattccagcttcccgcggggctcantgtggtctggcaggaaccggaagtgcagcagcatcaacgccaggaccactttcatctccgccatggcnaacgcctgcccgatgcagttcctgggccctgcggagaaaggaataaaagccagaagtgacctccccttgctgttctctgggtcaaagcggaaggggtcgtagacctgcaggtgagacaaagaaggtttgccagtgggatttcctatgtccagcagccttggagaganacttntntntnttttngggtnaagtta

SEQ ID NO: 587 - DNA, 479 bp, Homo sapiens
  "n" may be a, t, c, g, other or unknown
cagtatttagtaaaataaatgtatttttaaaatatttttaggaagctgcagaatggcgactgagtgcttcttgataagtctgcagtgttagttctatataggctcccttctgtgcttctgtttttgcaaanaccttgattaaatttattccctcagcagcctgatccttggccccttgagccgactggccatctggatggagcacgtgatacagctggaccaagttggttgcatcatcgattaaatctctctgaatctggtcaatcagcaaaccatcaatctttttattatttacaaaataccacaccattccaccaaagtatcttgttgaacgtaaaaggtcatatttcccacgtttatctatatcttcataggtcttgtgatgaaccttgatatactctgtggaatctggctcaaactgggcaaancanaaattgaggacatcancttgcctgtcctggctatacttatctaaaacc

SEQ ID NO: 588 - DNA, 556 bp, Homo sapiens
  "n" may be a, t, c, g, other or unknown
ctagcataccatanactttatttacttattttgttctccctactaaaatgtnagctctacaaagacagattttttttgtatatgaagaattgattgtnaacacacagaatttggaaacagtctctttcctcaaancattttgaagctgtanttgaggggaangtgtctgattaggggattgaatanctaggttgcagtacatccattcagtgaaatactatgcaatggaatattatttggccttattttgctctaatatgaanaaatatcagtgatatgttgttaaatgaaaaaagcaaattgcagcaagttgcanaactatatgtactctgttttttgtaaaaaganaaaagaagttttaagaaaccagtagtttaaaaacttcacactgtgacttgtttanatccanaacctgttacctgagttagatgtcttgcccattttctctgttcatatgggtgtccnggaaaccttaggcgttataccncccanttttgcctatataactgttaatacttncccaacttgggncanttcttttccccaatnccccgga

SEQ ID NO: 589 - DNA, 474 bp, Homo sapiens
  "n" may be a, t, c, g, other or unknown
actgatgtacttaaaaatagtgcttcttacaaccaatggcatcttagagtcaatgaaatatggtagttttgatcacagacaattcttgccaataggttgcctttagaacacaactctcaanaaccaattccatggttcattacttttatatccacaaaataaagccatttccaccctattgagggaaagaaaccagtcaatctcgcagctgtgacctgatctaatgatcgggtccctccattatacagcccaacagcacctttccttgatagcacttaccacatcttctaagtaaacatttgtatatattttattaatgttgctagactggaaactcaacaagggcaggaagcagatccatcttgaccactttgacccctgtcatgtctcttgggactancacantgcctaaggcacattatttgctcaataaacatttaaagaatgaatcctatnaagggttttaattggaaa

SEQ ID NO: 590 - DNA, 474 bp, Homo sapiens
  "n" may be a, t, c, g, other or unknown
ccaaaaattgaataagtatttattgttccanaaggtacattgctttttatacatatttcataaatgatacaggattttacacatgttcaatantttgctatttgtttaaanaacttttctccatgtcctccctcccttgcttcccacacaccccaaaaanatttgctcgttgcactgtgctgtttcttcttaaaaaccctatgcacaaacaggataaatgggttaaaaataattcacacaacttaacaaaaataaatgagggaaggagctgacaactgggggtggtgganggaaaaagaaatgggcggagggtcaggaaatgganacatgcatcctttcattccgtcatgccaatgaaaggggtgttggcaggaatancacancancancaatcctggctggccttcaacctttgcaaggcacctgaantctgggttgtcatttaaagttttnctttcatacccaatnatcccc

SEQ ID NO: 591 - DNA, 559 bp, Homo sapiens
  "n" may be a, t, c, g, other or unknown
aacaagggggcagtcatttaatgcagaaatccagttaacataaagagacagaggttgaacaacaggtcttcaaacaatactgcatagtgtcacnagttagctcttaagcacgtttgatctgtttatcttatgatttcgattccagtacaaagacagagaagagacttaaaaaaaaaaacaataaggcaacagaagaanaatcttcctgtgacaaggaacgtccacaaataatgcacaaatatttggtgctgacacaataagacaccatcaggacaanttctgaaaatgctgcattaaaatttaacaagcatgatacaatgacaagaaaattatactcgctttgttacgaatccttttgcaagtaaaaatgacctcgggtnattgttacntacaaactttctgaaataaatggaaatcatacnaattttnccattgcagtttctnctttctctaccctaaaaaattcccatgggcctgcccctattctcacantccaaccctaaatatccttaaagcncttgaatccccnntatcttncctaaaaaggtnggnagtttgc

SEQ ID NO: 592 - DNA, 446 bp, Homo sapiens
  "n" may be a, t, c, g, other or unknown
ccaaacgattgcatttattataaacaagtgtacagaccctagactcagaaacacaacagatttgagctaagacagctctggtgaaacagtaatagagggaggaggaacacgaggtattcatgtctgggccagagctgccatccagggccccacaccccacctttggtccagatggcccattggcccaggtgtccctgctgccagaacaccgtggactggggtacaggagttgttgcatattccatgaggctggtgtcgggaagcagggactcacagttgccaggttgtccatctctgagccaatttccctccacaacccaggggtttcagtctcatatcaactatcctgtttgaaacagaaaacaggcaaaatgtttggctaaaataaaatgaaaacactgcanggaagananctgantgtgctggtggacanganccntgctcac

SEQ ID NO: 593 - DNA, 470 bp, Homo sapiens
  "n" may be a, t, c, g, other or unknown
ggccattcagacttatttttatttacttataacatccattttctttttagaggttttaaggtatctcattgaaaattcnaacaaaagcccntgaganatacaaaataacactgtnaacatttaacacataacataactganataaggagtcngtaatttatcccaaacaaacagaaaaaataataataaagtggatccttgtntaanataattttaagccccnggaattgttttctctagtacaattgtncaattactgaacattgacaaatattgattgcttanaatgtnccagcacttgctaagtncctttcttaanacctgccatcctttgtaagttgattttcttcngaggggatcctgaaattaaataaaataatcccnaattcttttagaattacattgaaaanatgangttgcttttanaatcncaatgttttangacttttggggtgtncaatttcctgggc

SEQ ID NO: 594 - DNA, 591 bp, Homo sapiens
  "n" may be a, t, c, g, other or unknown
cttgttctatttctttattttagctttacaganattaggtctcaagttatganaatctccatggctttcaggggctaaacttttctgccattcttttgcccttaccgggctcaaaaggacatntcaggtgggatacntntttctctttcaaanctgaaaaaagggtctgagctgcggaatcagtaaaaaaagccttggtctcagtgactccttggctttcaacccacctagcctcanacagccagnaggcctttttaccactggatactgatganatgttttaggtccttgcactttgcaaaactcctttctcccagtgggatattattaggacatacccaggctaaaaaggccgtgggaanctttggaggtangangatangatccanacagggttacaataagganaagggcattctctttggtgcactccatantccaatggcatcctgaactgatccatttaggaaccaagggtggacttcctccttgggtccttggncctttngattccccnactgggggcnggttangaacnttaaaaaaaccccccccggtttttcccccctttctntccacctaaattcactt

SEQ ID NO: 595 - DNA, 394 bp, Homo sapiens
  "n" may be a, t, c, g, other or unknown
ggctttagagaagcattaagaagtaaggcatgaaagcacaaaaagggaactgaaatccaattgcaataattactcatgcaattggcctctttctatgtggcattatanaaacctcctgagtaacacagtttatggttttacaaaanaaaactcctacatcattgcatggcatggctaccgcttccttagaccattcaganaatgatccccaagtatttttcataaaccccatagggtttcctacattaaaataaagtgacaganatcacgccttgaataatttcacaattacagcaatganttgtnctacttccaaatgacgaattttctgctccnaataatgggacaaaaggcatcatcncatggacacantcnatttcncagtgatggactc

SEQ ID NO: 596 - DNA, 517 bp, Homo sapiens
  "n" may be a, t, c, g, other or unknown
gaaaataaagtgctttattgctgaggagcccagagagcttcagggcggccatctgggggctaggactgaagtcccctaacttttggtggctcttgtgaacagagacagttgagacttcaacatttcaaccccatagaaggcaaggaagtgcagccaggggaatggggaggcagggaagaggcatgaggtgtgccgggagagcgattatgtgcatctcttcccaactctgagttcagtgcattcagtgatgctggcagcatgacatgggacactgctgggagaatttacaccacagaagctgcccaaatgcaataaatcagggcttttttcccctcccagagaactggtttactatagacgtgtgacacaccgtcccgagctagtgctgaacccacccaagcctggctactgtgacaagctgtcacctccccactcggggggagtgccaactcccagccctgcacatccctacaatcagcanaacaganggggctgancaaangaaanggacnnaatt

SEQ ID NO: 597 - DNA, 588 bp, Homo sapiens
  "n" may be a, t, c, g, other or unknown
gcaagttataaaatgtttattgatatacattttgtcttttataaaacttccgttggccacattgggccactgtgcaccacagtgccagtccccangtggccagggcggaccagtgtccactttcgggtgggggctggagccaanaagctgtccanganctgcccagtgggtcctcatggcctgcgggatacctcaagtgctcccggangcagcctaagactggctcgtcccggantcagaaaangcaggtcaactacccaaggcggccaaaggcccttcctgtctccaganccttgacataaccagaaatccccccatcaaagtcaccaaatgactccacngggggaaaggaagttgtttgcanaaaaacttanctacnaggcatgtnaaccagaactttcttccanacaccatttccttcacatttgctcactgataatgccttaaaaagatcaaatctctggaacaaccctnaatgcaggataagctctggcctgtnctgctggganacatccaagaagctgacccaaagcaaaantgctaggtggtttttaccctcctttacaaccacctaggcaagaaggcccc

SEQ ID NO: 598 - DNA, 603 bp, Homo sapiens
  "n" may be a, t, c, g, other or unknown
ctcttacaaaactgtaacctttatttgttgatccaacagtacgttaaccacttttaccccatccccactttacacggtacaccaacctgaacagattttgtgccacaatttcattcaaagggtttgtcattcactttatgattgtgctggataatctagatgtaagcaactctggagattttaaaatatgggtcccctgtatgagagtagcatagtttatagcatacttttaaaaatggcattcggtaattttgccttctggacagaaagatatcttcaaattgcaaacacatctatttccacaaaacaatttggtcaggaaattttatttgaacattctaaagcaataatgctttagatgttacttaagtgtcccagacaggattaacaaaattaagtgtctctaaattacaaatttggctcctgtaggagtctcagaaaataaacagaagaaaacaacccccctcccaaaagaagtatgaccacacattttgaanaaacccaatgtttcatgccatggtaggcaanannttaaaacccccccaatcaccatttcctacccaatctccttaaaaaaaattnnccgttntccaatgttctcca

SEQ ID NO: 599 - DNA, 294 bp, Homo sapiens
  "n" may be a, t, c, g, other or unknown
acaaattcttttttattagtcaaaatcncaatcaccttgattaaaaggatgggacactccaccctcagcaaaaaatgatacagtttatanaaaacctccccgcccctcccacatcccaattaaaaactacaaaaaaatctccccnccttccctacaatntcatggtnntctgactcctccagtggcactgcagctctggantggncagctcaccacagcaccctccacttcaccttggggaaaagaaggatnctggtggttaaggaggttaaaaccattntttccantnntgcc

SEQ ID NO: 600 - DNA, 497 bp, Homo sapiens
  "n" may be a, t, c, g, other or unknown
ctcggaaactacacagaccatatgttttatttaatgtgaaggnacaactttaacattaaaagcaaagcgttttagttatttatgatgtaactgtcagtaccagctcataaaaatatatttttgcaagcatatcattgaanactctttcagattgtcaattcaaaagtcaatataaaaagtcgaagtctatttgtagaaaatcaatgacacattatagcagttccacataatattattgctggacaatctgttcaccanatatcacagggttttcttcatttgttgcacaatccaaatggtccatcatctgatagctgttncctttccanaaacttttccattcccttacttctccaggcaacaactgaggcagtaataattgtgcaaggtactaaatanangaaancaggtgcccctttttcatcancaccagaaacaacaaatgttattntcatgccaaaagcataggcnactgtaaacaaacatattatatntta

SEQ ID NO: 601 - DNA, 467 bp, Homo sapiens
  "n" may be a, t, c, g, other or unknown
gcagtaatttaatttaataaaataaaattataagaacaaaaagttacatttctaaagtaccaaaactgcaacaggntcatggaacagaacctagggatccaagaacataagaagtggtggtgctgggcaaggctctgcatcccctttcctcagcacagcaccatcttcaccctcctgggaaagcagcattggagcctacaccgcttgtgcttttctcaccagggtaagaaatgcaggtatttgcanangggaatgagtctggaaagtggcanaacacanctagggcaagacttaagggaacttgtgggaanaataactggaacctacctatgctctcttgaccccaaactccccaaaacccctcactgangactgtctacccccggggctcanaataaactgcttactggaaaattggtnactttaggcnaaaggaaagntcctcccggggtnccccatnccccgct

SEQ ID NO: 602 - DNA, 489 bp, Homo sapiens
  "n" may be a, t, c, g, other or unknown
gacatttcaataaaaatttattgaaatttcagtgatgttttaaagagagggggaaaaatacagaaaaccaaagaactcatcaacaactataacacaaaatataccttcatgaatttgtctttaaaccatctctcagcacctgacttttgaactgtgaatatatctctataggcaggcaccaattcaaaacaccgatactgacaacagtagtaaattccacttcgttttgaggaaatcagagactancaaatacaaatnacaaaagaaaaattaaaaagtcaaaccgcagcctctgccctcctccctccccacagcaatctcagttntnttttaaggaatttgaaatgganctggaaantggccccctnccccaattttggtgaaaataggaaataaccctttcccccactttgggactttnaaaaanaaaacaaaantnttgcaaacaactcttttgaaagggttttggtnttnggcaaganttttttt

SEQ ID NO: 603 - DNA, 554 bp, Homo sapiens
  "n" may be a, t, c, g, other or unknown
ggagacaaatcaatgtgaananactttaatggcaaagtgcactgganagttaaaatggttacatgggtaatttaagaaaaaatttagtgggaaaaagggaaagggctgaactgccaaaataattttcttatccagttttacatttgctttctccatgtgctacaattatanacacctgatagttcctanccttagacataacttgcagcatcagccactctgctgcactttanatcacattagttagggctanagcccanccccatttacacggcatctgatnaatggttagctgtggcagttctaccataatgccattttgctccaaaaaaatccanttaagtngctgtccatggcccantantttcncctctgttgcccccaaaataactttgggatggccaaggaacanctgtcctgatttgggccatttaggaaaaaatggcataaactaatttttcctttaggcttggatttttnccccccatctggggttgacantttccttcctgggatcccanttttaggtttcataaataactcccccttgactt

SEQ ID NO: 604 - DNA, 417 bp, Homo sapiens
  "n" may be a, t, c, g, other or unknown
agcagatacgtttattcaacacagtgcatgattcaaagcatcggatattccacagccaacaaggtttcctattccctattacaaaataccggataccctgaatatagctcattcaaggtcctcgttcctttttccctatatctagaattaaacaggtttccccgtttagcgcacatttcacgttcgctgaaggctttgggganagggggaaacagancttatgactgcccctctgaaccaaaggcacttaatgttaaaagataaagcacagtanagtcaccccacagacattcctatgtgttcaacggctgaacttcancataccatcaccgggncccatgtgggattcatcataacaacntnaaagacactgatttccttggnaaaaacaaagtgcagtacgaatatnaaggantc

SEQ ID NO: 605 - DNA, 547 bp, Homo sapiens
  "n" may be a, t, c, g, other or unknown
aacttctanaaataaattttattacatttatagttgtatcccnttgtgtganataattagganttctctattaagtnattaatcctaactatatccttggggtgaattgaattctgcccccacccgaaagaatgaccttgtccccttccccattccanctcaaggcacttaatattacaaaaaaaaggantggctggctggaaaaatgggcctcaagtcagaaatcccccagtgcaacttaagacaaacagagagaagtcaccttcctcttaggaccctccctgggttngcagaaggaaagaaccagaagtcttcagtaccacagtaggcttcggtatctccctagccaggtgagggacccccaggcattctccctgcccgcaccgagtctctcttcacctggctacttcctggccacacgtttgantctgcccttactttctgctctganctgcctgaatacnggaaccanaattccctctgaccnaaaattccnaaacccngcaaggaggccccccactttcaaaaatngggaaccaaatggccc

SEQ ID NO: 606 - DNA, 533 bp, Homo sapiens
  "n" may be a, t, c, g, other or unknown
ccaagtcttcacaaaattttatattccccaagggtgccccatcacaatgcctgtgaancttgantggnaaanactgaagnctgaactgggggntacagggggtcctggctcaccggtcccccccgtaatctgtaaaacatactgggcnaaggaagctgctggaagactgaatctctcccttctccaggcaataatgangcatatgcctgttggccttgggcccattaaanatcattccanccccagtgctgttctctgaattcttggggaacacaaggatgggggctcctaatgangacccanaaactctganctctcacaactttcaaaggacacttgcctccctcctctgcccacacctccaccattacagcatttgatccncaaattaagaagggggggtcctattccacacctctcttgtttccccccaccctctnaatttttttaaggcccnaaaaggtttnaaattagaacccnccctcctgggctnaaaaaatttctccttccccctnttttccaagnatttctgg

SEQ ID NO: 607 - DNA, 479 bp, Homo sapiens
  "n" may be a, t, c, g, other or unknown
ggtagaaacaggatcttactatgtgggccangctggnctcaaacttctggtctcaaancaatcttcccatcttggnctcccaaantgctgggaatacagggcatcagccacctcacctggccaacctggtatttttctttcactgcatttcctgantctgtaattattattattatgttttaaaganatgaagtctccctctgtcacccagtctggcatgcantggtgtgattgtagcttactgctaccttgaactcttggactcaagtgatcctgctgcctcagcctcctgagtagctagagctgttagcacataccaccatgcccagctaatgtttaaaattttttgtanaagtagggggtctcactatgttacctaagctggtttccaactctgggctccantgatccncccccttggcncccaaatgctgggaataaatcntaactgccccaacanccggnaataanttttttcc

SEQ ID NO: 608 - DNA, 478 bp, Homo sapiens
  "n" may be a, t, c, g, other or unknown
cctaagcatctgctttaatganaanggtcctgttcatgccatgcctgtggttgactcaggaaacangcagggggatacccatggctccnatgganatggggatgggganattgtggacaaagatgcacggtggcggangcccttgcagctttanaagctgctactgcagganaanatttggatgaaactgattaggggaggggatttgcacanggaggtaagctggtgtcatgctgancatgcanatgcatttgctccctggatgcatancaggtgattctgccagcatgcaccantgcanccttaccagttgtttacatccagcatctgttctgattgtcancatctgtcccatgctgcttgtcacatatctggagtttcactctgtgtanatganctgtcattcaggacactgctactctgtnccactgcgttctctctcccaggttttncccggcnctccccnttgacggttccn

SEQ ID NO: 609 - DNA, 531 bp, Homo sapiens
  "n" may be a, t, c, g, other or unknown
ccacggaaaacagccgtttttattccacaaacagtaaactccatccactacacagtgacatacactgtgtagcacaccccatcaccttggccagtgctgccagccgacctttctgtggtgatggaaatctttttctgtgctgtccaatacagcagccaccgaccacttttgcttattgagcacctcaatatanaggtggccactacaggtgaggaaatgaatttctaagttaattcaaattcaaatgccacatttggctcgtggctcctgtactggacaacacagctgtaggccctgacctggtccaaggcactttggttcaaaanccactctgaagaaancaattggcaaaaacagcccttgggctcccctccccaaaaaaaaaacggcagcttgcacctgctggaaaagggcaaaaatcaaattggggggaccctcnggccccccngaaaaaggttggccacccccttggccagnccncctnttcgggggcnccccaattttaaaggtccggttaagaaaattttnaaa

SEQ ID NO: 610 - DNA, 510 bp, Homo sapiens
  "n" may be a, t, c, g, other or unknown
ggttggacaggtttttattggaaaatcaggaattactttccttccctcgtccctgcctcccccactcaaanaacccactccagtggggnttgtccttcatctgcccctangaatccccatccccagctacacaggcactcaggganaacgcacatgctgtgtgggcagacagccccaggccaggtangcagtgagctccctcaaatcctcccacccccaggactcanganggaggggcaggaaaagtgtgggcccggtgtgcantcctcaggcggcctcctgagctcgcanccagccaggccttgtgcctccagnatggatggtgtnatgangcacatgccccntaacctttcccttccggaagggcttaaccaaaaaatntcttgtttaaggggcttggganaaggttgggaaaantacnggaagacacttaactcttcccccttgaattgtttcccctccaaaaaatccccccncccccnaagaagccggaaccnttttncccnaaaa

SEQ ID NO: 611 - DNA, 596 bp, Homo sapiens
  "n" may be a, t, c, g, other or unknown
aactgagtctggttgtttattgaatgcaaattcattcatagaaaacggaaatgcaaccatancatggagacgctctgagaaaagatccaganccacctcatctcccagcccttcaagcagagctataaaaacaagtttgggagaaaaacacattcccatccccaaagcagangccccgcctganctcccccatcctcagcatctggggtggaccangtgggacnaaagggatccaaggaccagggtggccanggtgcccaaanctggggcaattctttgtaaactccaaggtttcataggtatgtgtgtgcatgactaacacanaacttgcctgaagactggacggaaacttanaaaccaccctgggtcctataacgaggctangactgggcacgtataaggaaacacacatcccttcctgaaacccttttctaagttaggcctggggtttcccncncctttggaagcaaacgggctgaatcttttctncccccctttgcccctgaacntccttgggcnntttcatggccttaaaaggccccccttgggtttggcaaaataaggccttaaaaaaagaaaggaanggttaggcctcc

SEQ ID NO: 612 - DNA, 380 bp, Homo sapiens
  "n" may be a, t, c, g, other or unknown
gaggcttggaattgatttattaagcacatcccttgccaccctcccaccttaaaagttttcagtatcaaaagaagctagcgcaggccacccgagtccctgaggttggagtcctagcatagctcccctccctcaaaaagggacaaggggtcaggggcaaaacaaaaatccagtctgcttcaaccacggagactgcctttgggatggaaagtttctggagctccctccattctattcctgtggggcaggaacatgccagggctgctggtaaatggcaggggtcacctttaccagggcgcaggcatantgtggcccctgcctgccctggggccaccctgnaacagtaagaccctctgggannggaanaaaccagaacccnccnt

SEQ ID NO: 613 - DNA, 369 bp, Homo sapiens
  "n" may be a, t, c, g, other or unknown
gaggcttggaattgatttattaagcacatcccttgccaccctcccaccttaaaagttttcagtatcaaaagaagctagcgcaggccacccgagtccctgaggttggagtcctagcatagctcccctccctcaaaaaaggacaaggggtcaggggcanaacaaaaatccagtctgcttcaaccacgganactgcctttgggatggaaagtttctggagctccctccattctattcctgtggggcaggaacatgccanggctgctggtaagtggcaggggtcacctttaccaaggcgcaagcatantnttgcccctgcctgccctngggccaccctngaacaatnaaaccccttggaanggaaaaaacnaa

SEQ ID NO: 614 - DNA, 584 bp, Homo sapiens
  "n" may be a, t, c, g, other or unknown
aaaggtttctgtcctttaattttttaacagaatatacagagccacacaatacgatttcaatttcaaattatgggagatcatattcaaatatgcttaggtttgacaagttgctgttacaatactgagaactttcatgaaaacggtatttaacaatttttaagataatcaaatatctttttgctacgtgggccaacgcattaatactaacttgtttaaaaatgcagtcttttagacttcaaattattataaaacaatatcaagatcatatagatatacttcctgattactcaaaactcgttccattctgatggaggctgaaggtaaatgttattatacattagaacatttcatgaaaccacttctcctttgcacttacctgtaaaagtcaaaaattaaaccacaatttcctaagacataactatttctagaatacattggtgttatcataaaagactacaagttaattatcatttttatactaacactttttaccacaaccatcttcctaaaaanaccaaaaaaattnggaatttggattcccctacataacaggatccctccttccgaatttaanaatttccccc

SEQ ID NO: 615 - DNA, 481 bp, Homo sapiens
  "n" may be a, t, c, g, other or unknown
aaagcaaagaactttttatagtgtttattagatcaaggaccggttagatagatgatgggctaggcaggtgggggaagacagagctcactgccctgtggggtctctgtggggccagcccctgatgcccatgtggccactgatgcccagcttcccccaacaccccaacacaggcccaggacaatattacaaaagtgaacaaatgcaacctttttctgcttttacaaatgacatgtctccatccccggccagcaggggtaggggaggccggttgaaagtgacactccgttaaaaaggcaacaacttttataaaatgaagactaaggaaacagcccagggttcggaagctgagatgctaccctgggggtagagcatanacatgggtcgggcagaccttgtctcctttcacggcattcctggagggtaagaaggctgtctgctcaggccactggggactgaatccaggagncccttganntnnncn

SEQ ID NO: 616 - DNA, 383 bp, Homo sapiens
  "n" may be a, t, c, g, other or unknown
acacaattgcagganattttattggccccatgacatccagtgacagtgtgggancangctactctccagggacatgtttttgggaggcatatgganaaaggggccaagcgangtggctcacacctgtaatcccancactttgggangtccangtgggangatcccttgaggccangagttcgagaccaccctgggcaacagancgagatcccatcactacaaaaattcaaaaaattagccaggcatggtggtgcacacttgtantcccagctactcaggaggctgangtgggagaattgcttgggcccangaattcaaggctagagtgagccgtgaccaccantgcactctancctgggcaacaganaaanaccctgtctcnc

SEQ ID NO: 617 - DNA, 564 bp, Homo sapiens
  "n" may be a, t, c, g, other or unknown; "n" may be a, t, c, g, other or unknown
cctttaaaaatattttattaagcattgatttagaaaacgcaagacaaggttgtaacacctcagggcaaaggnttgaaggtgaaacaaataacactataaatattgcacttctaaaatctttttttgacatcttcacacaactcaattctaaaatatccttttacagagatgtataaataaacgcttccaagctgtcaacgcttgacacttttagcttcctatcaccgcactaagtcggcaggtttccaatcagatagctgctcctctgacagcaggcaaagaacttccctcagctatctcggaggcctcatacctccatcatgtgaagagtcaaccagtcccatctttcggaatcctctttcagaatatgtaattttataagtatttttttttctactgaganaacatanatctttcaaaggcaatggcagaatacagcttaaatggaccagttccctgttaacattgcttattttttaangnatccaagaactctgatccttggtcttgaacatcatnanaaactttttggcatnattttgccncccccacttcncctatttg

SEQ ID NO: 618 - DNA, 318 bp, Homo sapiens
  "n" may be a, t, c, g, other or unknown
gtggatttnccttttaatgcaaaatgttgcaatacaaaacaatgtggaaaaagtcctgttcctcaggacactgaagggaggagtgaggaaaaaaggacagagctggacgtctcctcctatttctccctccccaagtcactctgaggggaaaaacactgctgcctgctccctgggcctgcccgcatacaangttagagccctgggtctggggcatccttagcctgaaatttgttgacatggggcanganaacaggagggaacnttgagggttttgactcttcgggctctaaaangattactcaggatctgganttccgt

SEQ ID NO: 619 - DNA, 554 bp, Homo sapiens
  "n" may be a, t, c, g, other or unknown
atttgtacaaacaaaaatcactttattcacatgccagaacagtgtttgagtagatagttttaagggcaatacaatcaatttcttgaactcagatttgaatttttaaaaaattatattcaagctctaagtattttacttacagaattttgcacatggctcactcctttctgcacaaaggtaaaataatatctttatttgcttaattccccattgttttgttgtttcaacatgattttgtaccctcagtctttcaacgttagtcaaacgttacattttctttcactcttacccttttttgagcttcatttcctctctttatgttctcgagtatagcttcgaggtgtagggtattcattcccaagatccacaacaattacctccctagaaaatgtcactccttttaaaggtcttttttggctttcaacaactgaaggagttctagtgacagatgtgtgnatttttctgcaaaccatcattcccttcttggccaggttcttcagcnttctaaggctcttgtttccanttanttngggtctccccttntgccccaaggg

SEQ ID NO: 620 - DNA, 587 bp, Homo sapiens
  "n" may be a, t, c, g, other or unknown
acactgtctaaagcatttaatggtctttctttaacacagccaactcccccgggtttgaaacagtgttaaattctctcttgcttgtggcaaaagaagctgtcaagtccaacactgaaaaattggtaccatttcctggccagtaagcacagaacagaggggctaaatattttatggttttatttatttactgtgttctcatgctgtgtttttcttttctctgtctctccctcctgctcgtgtctgcccagggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgcttctgtacacggtgtcctcgcaacaanttcggcgggtggtcgtgcangtgctggctgccgctgtcgcttgaacacgccaaccacgagaagcgcctgngcgacatgcgcactcacaaccgaagggcccgtttgggcaacgcccgtggtttttgngtccggggccagnctttn

SEQ ID NO: 621 - DNA, 550 bp, Homo sapiens
  "n" may be a, t, c, g, other or unknown
ctctctaaacactatggatgttattcatttcccatttttgagtcgttttactggagtcacaattggagatgaatacttgatgcaggacctctgagcgatctaaacactttcctgaaggaatatgagtaaatctgtgcaggttcttgaagtactgccattccttaaattcatttagattacagtgtgtaatcataacttttgatccatcagctccctttgtcaaacactggtcatactgcatgagttgatttgcttcattgattctgaaaagctgattccctcccatcctgtggcagggtcctagttcaacaaagcctccatttgtttttcccatgctatcaatgcagtaagcagtttcgaagcctctgatttctccccagtcaacatttttgggtggcaaagggtagtgtgaggtgatatcataagctatttcttccatgaacccttaaaacttttgcagttggggaccttntcgaaatttttcangttccgaaatatcccctatgggaatgnctggcgattaaggccnacttgccttnaaatngncttt

SEQ ID NO: 622 - DNA, 544 bp, Homo sapiens
  "n" may be a, t, c, g, other or unknown
gagatgaagttttgctttgtcgcccaggttggagtgcaatggcgcaatctcagctcactgcacctctgcctcctaggttcgagtaattctcctgcttcagcctcccgagtagctgggattataggcacccaccaccacacccagctaattttttgtatttttagtagagatagggtttcaccatgttggccaggctggtcttgaactcctgacctcaggtgatctgcccgccttggcctccctgtgctgggattacaggcgtgagccaccgcgcccagcctattcctattaattcttttaatccttgcaacccaagttggctaggccgatagcattaatagtcacattctatgggtgatgaaactgaggataaggaaggatacacctgacagaccatcaggaaacccggtgggctccagaaataactggttgctagtgaacccgccgnccccatgagtggcccaccttcattaagaccccacccctagggacactacggttgaggtttgccttnggggccaaaggtaccccggggnannggnan

SEQ ID NO: 623 - DNA, 549 bp, Homo sapiens
  "n" may be a, t, c, g, other or unknown
aagcccatacttagtttattataggcatgtctaattgaaatccatgaaaacagttacatttaaaacattctttatgcactatacttgaaaatgtaaaatataataccacttaagtacttcccacattaaactgatttttctttttttaaaaaaatttttcctagtcgttatttagctttcggacaccataatacaatagaacagaaagagtatgttaaaagaaaaatattaggtagaatgttgtaaaacttttaatttacccatcatatttaacatttccaagactattttcctgcgcctcatctgccctcagagagaatgatccccacagtgatgaggggtcagcactctgaaagccagttgacgccagacaagctgctggaacagctggggcacagctccgcctctcctccagcccctcggtcccatgaggccaaacaatgaggacagaggggctgangggtgtgtccagggcccagtcccacctcagcaggaangtggcgtcagcactcgcagtcccaggcttacgccgnatngcagtcccagggg

SEQ ID NO: 624 - DNA, 373 bp, Homo sapiens
  "n" may be a, t, c, g, other or unknown
ccaggacaaaaaataaaatatttattgatctatcacagcgagacacaaaaagatgggcggggcaggaatgggaactgctctgaagttcagtggaccgagggagggatggggggtatacagtactgcatgtggggacaccccgggtggggaggagatgcctggcaccccagtctgcacagccccgcacgccctgggggagtataggatgggggtggaggcagggcacaggcggccatgacaggtcaaccaggttgangcctactccaccgagagcccngagccctccaaggaccccaggcactgntgtcccatattnggctgctttanccggcaccagggcnccaggtactgccccnaagccaggaacaccanc

SEQ ID NO: 625 - DNA, 576 bp, Homo sapiens
  "n" may be a, t, c, g, other or unknown
aacaagcaaattttaataatgccttttatttctatacaaagcaatgtaactttctgaaaaaaaaaatggctatacaaaaccctttaaacataagagtacagagcttcaaatggcaacaagaagttaagaaacatagggcactgtgtcgttatgggtgaatcctagtcgtcctgcagcccaaggtccaagctagtttactccataaccttaagtaaataaccgcggttcctatgaatacctttccaaaaccatttattataaaaactcactctttatccattatcagtattaacgtatcaaagtgagaaagaacatgggagagaaaaatgacaattaatgcagcgtgaacattttcatcctgaataccagtaaggactctagatgatatatggtgcccacttcatgtgcctcaaaagattttaattttcagaacatttaaacgattaaagagaaatcatcctcttaactaggtattttaaagcttatcaaactgnaggtttacatttgacaaagcttatggaccacccaatacgtagaaataggaattncaaatatttcagntcgtggaatatncaa

SEQ ID NO: 626 - DNA, 506 bp, Homo sapiens
  "n" may be a, t, c, g, other or unknown
gcagttctagcctttatttttctttgacgaggagtgccacactgagggcccctctgcagcgccgcacagggaagcggtgcctcggggagcagcctttcctctgatggggggaggggtcaagggatgcaggagatccacggcagcacacgcagcctgcaggcgcagcacacaggcagagcactgcccagcagctggaacatgagaatgagggccacaccacccagctgcagcacaagcccagcacggcgtgtcacggcacctggcaccaccagacccagaatggcctgtgcgagaggcgcacgccactgacgtggctatgcttgtgatcaaagcccgacacgccggaagaagagccgcagacattgnggggtgcacacacttgcagggaactgtggagaaccctgatgggtgngttaggacaaacaaggccaccatncttgggacaanacccaaggnccaagccttggnttctaagccggccccantttttttggcctttnaggggg

SEQ ID NO: 627 - DNA, 461 bp, Homo sapiens
  "n" may be a, t, c, g, other or unknown
agnggaattaagtaaaaattttgctatgttaaatttgaccttttcccaacagaaggcatttccttagctaccagcaaggcctanacacaaacgtctggactgtagtctctgactgccgttcccttgggtccaggcctntggcgggagggcgggaccccttcctctgactgttcccggggtcaggccatggggatgcacaaggccacaccgtgaggcaggagttcgggtggggcagggccgtggactggggcacccaccagtcctggaaaacagggctgggacgctgctctgtggcctcagacaagcttggtgggcgacatgctcaagtgagcaggggccccaggccacgttcaactgtccgcgaggcatgtgaatctganatggggctggctnctgtcanaagcacttaacctgaaatggggctggcttcttgccgggacactcgnttntggncctnttta

SEQ ID NO: 628 - DNA, 542 bp, Homo sapiens
  "n" may be a, t, c, g, other or unknown
gagacagagttttgctcttgttgcccaggctggagtgcaatggcgctatctcacctcactgcaacctctgcctcccgggttcaagcaattctcctgcctcggcctcccaagtagctgggattacaggcatgcaccaccatgcccagctaattttgtattcttagtagagacagggtttctccatattggtcaggcttggtctcaaactcccgatctcaggtgatctgcccgcctcagcctcccaaagtgctgggattacaggcaagagccaccgngcccagcacggtcttttcaaagaccagataatttatttaaccaactgtctaaagatggacattgtgattgatcacactattttatatgtaacattgaatggagtgggtgagtcctaggaaacattctctnctaaaaggttacatttttcattggctagaaagtgccnaaatagatctactggtgagaaaagacntttggaagcnntatgggcaaggtggcaggtgaatggcctnaanacttaagaattcaattgntacttaaaaaan

SEQ ID NO: 629 - DNA, 554 bp, Homo sapiens
  "n" may be a, t, c, g, other or unknown
gccggaataaaggtttattgtgctggtgcattatatctcagcacctggagagctgtgcagaggttgggggagccccagatggagggatgggggagaggacctcctgccagagcctccctaaagcaggacggagcccaggctccctgtcgaggactgacgaatattgnggacacaggctgccagacaatgtgtgagcaacagggggtggccagggcccccctgctccaggctgggcgtcagaaacccttccccagcccctcggacttccccagggtggaggtcccctcaaacacagcccctcagcttctaggctgctttggaggccagacaggaagagttccattcattcaacctgatcccagcagcagtagcgggatgagaaactcacccccaggcccgggggtgcttgganagcgcttgaaaggatttaaatgccctatccccacattcctaatctggaccactntgaaacaagggggccaccttaggaaaattaagaaccgtatttccaaaanggntnctgcaggatttaaccctgaactgtttnaaaaaga

SEQ ID NO: 630 - DNA, 572 bp, Homo sapiens
  "n" may be a, t, c, g, other or unknown
aggtgtcaaacagcagagtgtactttccaaagaacattttttttttttttacacagcaaatcccaagccttcccagtctcacacctttccacccattcataaaaaaacacacgaatttctcgcaagttccaatatcactgtctctttatcatctaaatagggccagttggacacctcattgaaacaaaaaggctgatctagatgaagtactctttcttttcttcggagttgttctgtcctccttctgcattgattatagctgtgtctgcgtctgctgcgtcatcggctcctttggcttcatgagtgaagtatgtacctttatgtctggcaaaatagcgccccagaatgatgagcaagcacagcatggcgaacaccaccaccgccacgacgccaccgatcacggcatgatccactgccctgatcgagccttcttcacctgctcgggaatctgaaagggcctcactgtccaggtctttctgcggaaatgggccaactggagtaagggccgtgaactngtgggttctggccgtcccccggttgggncggatncntacnggnttttaatccgnggg

SEQ ID NO: 631 - DNA, 499 bp, Homo sapiens
  "n" may be a, t, c, g, other or unknown
attcaaataaaattttaatgatttcagttcctgaaaatgtagtgtcattaaaggtcatttcctgctaaatttcaaattacagatttgtgggccattcctgagcagaagcatcatttctactaaatattcagcttgttaactaaggtaactgacagtatcatggcaggaggtgagaaggagcaatgatcagctcatagctaagaaaagggaaaaaaacaataaccaaagcaaaaaacaaaatagctacagatattagtaaaataataatacaatcccaaacatccacctcttaaattactacaaaaacaataccaataaagttatagcaaatacagtcttcacagatttgagtaactttatttgcattttatagtgatttcttaaggcctatatccaatgaaaccattttaaaagctctatggagganggggattttaaaaggctantacccntggcctttaaaagaaaaatgcntaaatttcngaatgngccagantca

SEQ ID NO: 632 - DNA, 553 bp, Homo sapiens
  "n" may be a, t, c, g, other or unknown
gtgtttcattttctgtttattacttgaaatcacggtgctcgtgtaggtttttttttttttttcaattttatgttttcatacataaagggggggagttgaggacctggggttcacctacganaacaacggtgggggacaggcanagccaggacaagaccgacaggtggggtgaggaagggtccanacatntccattatcattaaaaaataaaaagngggtggggaaaaaaatccaaaaactaccccattgaaatggccccagtaggggatttgtccctcccctttggagacagacacccctagggcaggggcactganaggcagggggtccaaattagaccagcagcggaccccgccacgggggttaatgctacacggagttgtcgccccctgcccaggggattcacagntcagcaccccctcccatcctcgctgcaggaggggcccccagacagtcccaaatcccatcccttaggttgggcccggaaagaaggctcggangggggaactcccagnanccagccattttttcccntttttaagagttcccaacc

SEQ ID NO: 633 - DNA, 545 bp, Homo sapiens
  "n" may be a, t, c, g, other or unknown
aaggngcccggtagctttaatgagcaccttttcctcactttgnccctccctctctactcttccccttcccgtcttgacaggtccagcctgccctagggctcttaaaccgcaggtatcaatccttctgtccccttagccgctccaggcgcctgcgaaggtccgggggcaccttggccccagctgccagcagctcgcgcagcctctgtttgggagtcttggtgagcacgaaattgcaggggaaggggccctnttcaaaggngacccgacagttccgtgtcactgaatggtagccctcggcactggcagtcaccatgtagtcccctggggtcagcagacgccaataatccccgccccacgccgtggtcacgtcatggttaatcccatccacggnaatgacaagcgtcaagcaatcccaagctccgnggtccttgncccttaccacttctgcaatggccatgcgcacctgnttcaagtaaggtgaagaaggccgcttttgtggtctnccacttctngggcaaattnattcttcgngangggaacttgtn

SEQ ID NO: 634 - DNA, 561 bp, Homo sapiens
  "n" may be a, t, c, g, other or unknown
gtagaaaaaggctgacttttattttcctgcagagcatcttcctcgggagagcagggagccccaagtcatcgagttaagagcaggagaatccccttgactaggttggggtctgagcccagaggcagggcctaaggaggtgcagagactagggccgggagtggtgaggcaaggttggggcctggagggacagctatgaccgttgaacttgcagaccctggtccaccttcttggagtggaagccagcggtgcagaaggggacccctgaggcgcagaggcaagtaacagtgccaggggagtggtcagggcagatcctttccttctcaggaggctgttgagggggagagtgtcatgctctaaacagtgaagggacagatgacttccataccccactcttccttgctggtgagaagtggacccttggagttcagtggctgaaactcagaatttagggtatggagctggacccagagaataaagtctcaagtagtanaangggcatntccttcagtccatggatttgggcctttggcatgaacaaccanggcctggatgttaaggatt

SEQ ID NO: 635 - DNA, 359 bp, Homo sapiens
  "n" may be a, t, c, g, other or unknown
atgagcngcaacaaattatttatatgaacattccaggnttcagttaactaaccncattccactcaacttacatganaaaaaattggggggtttttanaaangggatttaatatncaattcagngttaacattggtatgtttaaaagaaattaacccanataaaaagaatttggcctntagggaaaatcagagntctactcaaaatataatactaccaataaactactagcatagggaattttcaggatctaattaaaagcttggtcaatttgatggcgaantagtgncntaagggacatgagaaggaaccgtacaaagcccnttacccngcagtattggaatcgccntntttatagctg

SEQ ID NO: 636 - DNA, 581 bp, Homo sapiens
  "n" may be a, t, c, g, other or unknown
gaaagctaatagaccctttaatgcatgtccaggttaaaaaataataataataaagaaatgcttctggtggcccttgagccaactgttcaggtgtggagaaggggttcagtcctggccggagcaggcaggaataaacgtgggtgttcactgcggccagcagctccctcagacacaaacaccgtccttcccgtggtctggcccgttgtcgtgtaagcgggggacaggaagcatgagggagcttgtggaggtcgggccacgtgccatcccagacatcaagaggccccaatgggtttttacttgtttctcgcagtctggaggggcagccatgaaaactccaagcgccccttggcataagaaggagatgccccagactctccacgtccagaaactggtgggatctggctcatggggaggggcagagcggcagtgataggacttcaggtgagcccaaggggctgggggaacagacccagctactgagcaccctgcggcatgagacttcttgaaaagtggggaacacngggccttcaggactncgttgccttttggtgggcttggtcaanagttcttgagggnggaaa

SEQ ID NO: 637 - DNA, 584 bp, Homo sapiens
  "n" may be a, t, c, g, other or unknown
acatttcaaatatattttattactttccatcttagaaagaatatgaaacctgcatgcaatgctaatggtttctgacatgtacatagcatataacacagcagtacaatgcggcatatactggggggcagtgtgtggagggggcgttcttaagggtatatgtacagaggaaagggcgcatggtcatcttagctttcgaaagaggactgcactgtttaacattgaagaattacatggggaatcacaaatatattgctttagtactgcatgttctgttgtggtgagggaaagaaacatgctttgaaggttttcccttgtcaacagaatgtgtgtctgtagctgtgtattgcgcatgtattcatatatttttaagttttctcctaaggtttttgctgacagtgttgggaacctcacatgcttctgaagcattaaatattgaacctgtgaacctttcagaaatcctcaggatgggaaagaccccacaccttctttaaggatcatttgcttcgccatcacaggatcttggnaaaggtttctaaggtggggaaaaattaacccagggggggaatgaagcacatttttttggg

SEQ ID NO: 638 - DNA, 570 bp, Homo sapiens
  "n" may be a, t, c, g, other or unknown
aactcagtaattcctttattttgattttaaattaatcacaaccatcgaagtggtaagaaacagctgacaggtgtacttaaaaatactgaattgacagctacattgaatgcagggtttcccagggtagttcttattttgtcacttactccaattacattcaaggtcgttatgcctcatctttttcctgagctgtggcagctctaactggggcacccagagagatacataccaggtaatctccacttctacttttctggtagcttggccctggcaaaatgagccccacaatctagaaagtaggatgctaaacaaagttgaatcaacatatctttttagaaaatatcaggttagagaatactcctgaggacctgtttctaaccagagttgacaaatgtgaaaaatgcatcagctagacagcaagtcatgtgaacacagcccggactgcaagtcaagggaaatgggttctgggcctggctttccaggtaaccaaaaccattnttcaaaagcacttctggaatgccacttggggggaaagaaatgggaaaggggataaatcccattnaatgcttg

SEQ ID NO: 639 - DNA, 563 bp, Homo sapiens
  "n" may be a, t, c, g, other or unknown
gaagagtaaaacacattaaaaactttattgtaagtatcaacatctaaatttgcatcaatttgatacatcgttgctcattttgcagaacataacagttgcacattgcaagagtcaacttgcttcgggtcttttcatgctcatggcggtccacccctgccttccctctccctgacctgcatcctgtcctccacagtctgccctgcctcctgtcgccacaggttgaagacccaagccctgaggagaacctgctgccagggggctggctggctgcgagccaggagggccaggcagttagccctgccacagggaggggcaggcaagggatcgtttctcctcttcctgggctgagcccatgccaggccagccacagagtgccctagtcagcccatgtggctccaggaagcccgctgttgttcttctccatcccatttcacccgcagcctantggctaactctggatactctgagcaaaattaacccaagtttcatggagaactccagaaccttgaaccantgcatgggtatcccattctttggtactagaagtaggaaaaggnctgcnn

SEQ ID NO: 640 - DNA, 558 bp, Homo sapiens
  "n" may be a, t, c, g, other or unknown
agaaaaaccaagtgtctttattcctcgatcgtttagtatggcggtgggcggcgcccgcgcgggggagcctggagcccagggaatcgacctggagggccagtggagggagcggagggtgcgaggatcggctcctccgcaggccggccctggaggggttcttgggggatcgcgccaggccaaaagtctgcatgggcggccccgagcctccctgagccggcgcgccccgggcgtggggagaggccgctctgggcgcggtgccgctgcatggcccctgccacctgctcctccaacagatccaaccgcccccccagctccccgctcacattggccagcagcccccccaactgctctagtcggccccgggcagcaggcagccagtggctcagccccccaggagccccaggccagctctcctcctgctcctccgaagggcccagggtggagttgaagcggtccttcaggcgagacaggcnggaggccaaactggtgtaacctggggggtggcctccttgccccgcgggtcttccaanttttggccttgncggccactnaaanttn

SEQ ID NO: 641 - DNA, 553 bp, Homo sapiens
  "n" may be a, t, c, g, other or unknown
ggctcttaagggtctttaatggtttcattttgtggcccttccccccaaccctggtgactgtcccagcaagcagtcagtanaggtccccggagttcagtgggggcctggagatgtcggacttgtgagggaagggccactctccccttgtaacctctggtggctgctaggtggaagctgcagcaagggggtcccaagtgcagggcctctgggtgctacacatntcacagccagggcggtctggggcattgatgaaggtgcaggaaggacaggaccagctgggctggagtggactgggcaggctggaggcagctggctgggggcctggggtagccccaatgatgggggaaacaagcgtccaagttccccgtccatnttctgggggtgctgagggctaggtcctgtggctggggcttctcgaggagctgacagcaagtataggaaagcagggtccccatctgccgaaccccgtaagaagcaaagcttngcttaagcaccacangcaccgttcgatacccaccgttcacgggtggngggaaacnnactttnnaacact

SEQ ID NO: 642 - DNA, 206 bp, Homo sapiens
  "n" may be a, t, c, g, other or unknown
ctggtcccacagctgagtttattatacttgttttcttttacaaaattaaaaacatctaaaaccaggcccaagtggcagcttgagtccctccatttctggaaactgagaaggctccacctggcttgatatggacacagggtgtggggtggaggggaggaggtatggtgcccgaccnangaggcaangggcatgggtggnaanctgnn

SEQ ID NO: 643 - DNA, 309 bp, Homo sapiens
  "n" may be a, t, c, g, other or unknown
aaaggtgctacacaagagatatttattaatgttctgttgtatttacagttttaacatagcaaaccaagatgaattaccacttgggcagaaagcacatcattctacattataacccactggtttctgctaacacattgtaaaagcaagtagtacagtatgttagggatcatctcaaaagttccaagctacttctttctttgctcctaagtacctaatcctctccttactcccagactttggcctaatcaccaggagacaaaaggaaaataaggggggtggggggtggggggtggggtgannancgcnnnn

SEQ ID NO: 644 - DNA, 591 bp, Homo sapiens
  "n" may be a, t, c, g, other or unknown
aaaatgtatgctttcggccaagaagaagaaatgtgaattgctttggcaatcgtcagtttggccgagtattagtaatatgattgggctaaaatttgatgtcaacatgcaacatgatttattatatgagtacactccagtgacttttcctacaggaaaaaaaagcattattgtttgcaatctaataataagataaaataaagttagtatattaccttgatcaatagttttcagttttaatgagattttgcattcttgatcaagctcactaaattcagaacaaataataggaactgtgctttctatcctcaggtagtattctttcccatcctctgatatagtgctcaattcaggctgtagcttaatgcctgcaaaaaattcttggctttcgatggctacactttgtcatgaggattctccaagaaaaagacagaacgctgcagaatatcctgctccaagtctgagatttatgccatcaagtctaaaggagagaatgcctgactgnggctcttggggcagctcctctttgattcttgagaagaagcctagaccagctntgggaaacccctgngtttttgaacgggacnatcaaaa

SEQ ID NO: 645 - DNA, 414 bp, Homo sapiens
  "n" may be a, t, c, g, other or unknown
aaggtgcccggtagctttaatgagcaccttttcctcactttgtccctccctctctactcttccccttcccgtcttgacaggtccagcctgccctagggctcttaaaccgcaggtatcaatccttctgtccccttagccgntccaggcgcctgcgaaggtccgggggcaccttggccccagctgccagcagctcgcgcagcctctgtttgggagtcttggtgagcacgaaattgcaggggaaggggccctcttcaaaggtgacccgacagttccgtgtcactgaatggtagccctcggcactggcagtcaccatgtagtcccctggggtcagcagacgccaataatccccgncccacgccgtggtcacgtcatggntaatcccattcacggnaatgacngcgtnagnaatnccaa

SEQ ID NO: 646 - DNA, 521 bp, Homo sapiens
  "n" may be a, t, c, g, other or unknown
ggttttttaaaaaagtttaatattattacagtcaggaggcagcggctggaagatactcggctctttcccccaagtccaggttcagtgcattggcccccacacagcaccccagcctcctgcctgggcaaggaggccctgcgctcagtccagcttctccagcacagagggcacatacaccaggctgagctcactgccaaagttgcagacaatggcagcgttgtccagcaccaggatctggcgggcaggctgggcctcactgttcttccccaggtagactgtctgtaacaggtccccgtagtttaggtcccaaaaggagacacagccctggccgccagtcaccagcaggttgtctgagatgacacccaagcttgcaccacagcccaggtcctgctgaatggagtagaacttgatgcctgtgctgcggtcccagatgctgatgangtcattcaggccactggtgatgacacangaaggtggtacangtaaaggangggacattcccacngngagccaacacatng

SEQ ID NO: 647 - DNA, 582 bp, Homo sapiens
  "n" may be a, t, c, g, other or unknown
gctcacacttagtttttattagccacagtttcccacagttttctacctcctaggaaatacacagctcaccaagggcacccagtcaccattctgtcctgcttgcatggctgacactgttgctcaccgagggtgagcagatctgcaaagtcacccagggcctggtttcctcaggtacagagaaccccaaagaaagaagagccagaacttagagcccctttcttctccatatgggataggacacccaagacaaatgacccatgcatcatgaaacagaggcagggccctaagctgcccaagaggcctgggcacttggagttcctgccaacagccaggccactgaaccattgcctgtccaccctcccacagtggctaatccctggcctagttgtaaatgtcttttcagcgctgcacacttaatgcagtcggatgccttctgattactgggctctgagaccttcagctgctgaggtgcaagaatcaagcatgggcatgaaaggcaaagggctaccacaagcagcattcgnttggcttcaccttggcttacgcgaaccaacccaacangctgggacctangaaagttct

SEQ ID NO: 648 - DNA, 565 bp, Homo sapiens
  "n" may be a, t, c, g, other or unknown
caaaaaggcaacttttttttttttcttggcatcaatgaatatgcacttcagaaatctacagagaacttttttcactttgtatttgttccacagcattctagccaggagtncaaaataggagctcttcaagcagcacatgaagatggcccaggagccttcagccatccagagcagcagagcagcacctaaatctccacacacttcccagtataaccactaagaacacactagacccttggcattaggggatttatcatttccagttctattatctgggaatgactccaagggtttgtgacaagcttttgaaacgtaagtgctaagacgagtgtggacaagtcactgagctaatgaagaatagacccactgtctgcttggctctgctattttgtacctgtcttcacatgtggggaaacttcataactggccccaaatcagagaaattccaaaggactagacaatgtattgcctgtgaacttagaggcactgggaatagtgcaactgggaatnactagcttcatacataggcggattggttccnggnccaaaagcccanaanataaaa

SEQ ID NO: 649 - DNA, 552 bp, Homo sapiens
  "n" may be a, t, c, g, other or unknown
aacaaaggtgtgtttatttccatatattgctcattacatttttcttgccacagttttatctaaagccaggtcaaaatctttctctaaggtatttattaatagtgtatgttcttcagatataaaatccctctggtcaacatgcaacatttgaatatctattggcactgtacctctatgagatatttatgacatttgttaatagtgaacctcaacctcctgaccccacatccgaagttgggggcgatgtgggggaacatacacaaaattacaaccacattactggtcaagcactttatagctaaaatctattgactttaaaatagcattgtatgtgaattcagagttttaatgtattttgtggatcaaaaggaaagggtcaaaggctaagctgaacacggagggcactaaattagctaataaggcagctagtgcccctgttcttgccccagccctgcatatcactacatccgattctctcaaatggtataaaggaataatggacttnaaacttcaggggttnctgnaactgggntnaanttaaagccgagtntc

SEQ ID NO: 650 - DNA, 613 bp, Homo sapiens
  "n" may be a, t, c, g, other or unknown
agaaaaacagcgtctgcctttatttaagtcccgtcccccgccccaggtcccgcccctggtcccaccccgcgtcccggcgcgggagtccccgggggatggaagtagctatccagggctggctgaagggcccgggacacttgctccgctctctcttggagccgcccggaacgcggggcgcgaggctgctgcagggcccccaggaagtctggcagttgggagggcagtgtgaagacgggcacggtgcggaaaagggcgggtacggcgtccgggtggagcagcctgtcgaagcaggcccccacgtagcntgccgggcgcccggccctgcaagaagtcgggcagcacgcagctgagcgaggcgcggaaggcgtcgtgcgggcccgtgcgccccgggcccggacaccccatcctgtagccactcgcttgacaacgccaccggacccggagaagaaaaccaggaccccaagccggccttctggnagggtttgggcccgttgccttgaaaccaacccanggcccttggncnctaagttaacaacggttccaagggttacggcacccccanggaanttggcaaaggcccaacccagggggccaccagggcttnaaacccnnt

SEQ ID NO: 651 - DNA, 565 bp, Homo sapiens
  "n" may be a, t, c, g, other or unknown
acatgaaaacatgtttattgcctgaataataaaacttagctaaggagttattagaattacgattccccctacttgaagtacaagcttccaataaacagacagacagaagcaaaaccccaaatgagaaagaatacattggtaacctaaatcataggcatttgtgggtatgttcatacaatctacctatttctttgtaatttactatagcactgatgacaaagcatagacatacaatgagaaagagcaaatcagcatatcagtgtgactgtgcaaccactacaaagcttggccttcttaaatgtggccactttaacttacacacgcccacagaggcatcagaaatctccctgcaaacacgatttgcctatagttttgtggcaatactgttacatagaacaaaaacaactctcagaccatggttaataaataagagagaaaagaagttagaaacaactttcatgggttggcangcatgccaaggcagcaccttgaacccatttgaaaacaggcactgggatagcttttggagcccaggantgaaggtttaagcttnaangggctttcc

SEQ ID NO: 652 - DNA, 527 bp, Homo sapiens
  "n" may be a, t, c, g, other or unknown
agacttgaacacgtgtgggtcatacacacagacatgcaccctcacgtgtgtatgttattgacactggggtgtgcccgtttatgcatgtgcaggggtgagagtgtgcactcatgtccaggtgaactgggtacgcacactcagtcctgctggcagggaagaagccacagacagaatcggcagggagtgtgactatccacacggggtcgagttcacagcagccggctccggggaatgtctgtatgggcacacctgtggggtagtgtgcaccccctgggtcatgtaaacagcaggtgggggagtgtgtgccggggatctgggcagccctcactgccagctggcacaagttctcgggcaggctgtgcanaatggccttcaagttctgtttgtcggcccggatctcggcganggcactctcnaagccctggatcttgancttctgnttgcttggaattgtgggcttcaggttaaaggtccccggcgaaatntggcacatanggtggcnttcacaattttttttgcangggcan

SEQ ID NO: 653 - DNA, 554 bp, Homo sapiens
  "n" may be a, t, c, g, other or unknown
cttggaagtagggaggatttgaaagcttgaaaatcaagaatcaaaagacagtgaatctagaaggcatctgggagcagaacagagattgaagacgggtgggcacaggagaaagcgccaccatcgatctcggctgctgccctggaaatgtgattttcttaatagctgagttcatggttgcttgaggtcaggcctggctattcatttccagcgatgtctgaccagagaggactcatcattgacgacctcagggtcacgggggcgacgctgacaccggaacggcagcagcagcaggacgattaagacaaggaggatggctccacagacgctcatgagcgcataggacacaatccacaaaatgggctcgctcaaagactgagcggggacacagttgctggctacatcctctgttgagaaaggcccggaaatttcagacactgcagcacctgcaatttctgcacaggggctcgcttgcgaacccaccctnttctgggcttttgtcnaanatgacgtaaaagccctcannaccggggcaccgatcccagcgcattttggat

SEQ ID NO: 654 - DNA, 462 bp, Homo sapiens
  "n" may be a, t, c, g, other or unknown
gcctggaaactggagagctccctctgccagccccagggtctgccgagttcacttgacgaggccgggaactgcaggggcgggctggggctcactcagcatttatttcatacagctgcttaaaaagctagttttaaaatagagatcattatatatatacatatatatttatatatataaaatatataaagaggaattgagaagtgccaccccaaagaaaaagctatgttttataaatatttctgtagcttccacatcccaaaggaagaaaaagcaaaaaacaaaagaaaacatttacaacccaagctagtgattccatgtggtgggcccagcaggctcagaccccagggtgggccagggggtcccgcagaacattctgaanaagcgggcagacccttccggaggctggctntgnggcctgnaanggcaagctgtttaagctnancgatccaagcccggtcttaa

SEQ ID NO: 655 - DNA, 552 bp, Homo sapiens
  "n" may be a, t, c, g, other or unknown
gaaaaccaaccaggaacatttattaaaaaactaagcaagttatccccaagagggtgaagcaccgctggctggttctgacattcgattcaggctgaaggcacggcaactcctccagcccttgctgggaaatgtcctacccaggccacgggcagtgccccagtgcagctgggtcccctaaaagcccccaaacacatgatcccaccaaaggcttgaacagagcaacttcatcaagcaggcagggaccacacctgagacacaagggcaaggaggtaaagcacaggggactgggagtgggccagggacacccagcccccgtctccaactggcgccccctccaggggggctaacatgtggcgtggggccaccaggacctgtgcttgcccctggtggcggaagaactacccttcctcttgggtggtgggggggatgttgtccgcacacagcttanacgaccgagggtncaggaagaatcaaactcagtcaaccattcttttaacccaacttggaagtntgtgaaggccttggnacacaagtgcttaaataaaacacttg

SEQ ID NO: 656 - DNA, 553 bp, Homo sapiens
  "n" may be a, t, c, g, other or unknown
aagttgaacagaacattttatttctcagcaattctatgcgtacaaattaaacatgagatgaatagagactttattgagaaagcaagagaaaattcctatcaaccccaaggaggactcaaagtgaggctggaagaggacttagaagagtatgaaagtactctaagattttatctaagttgccttttctgggtgggaaagtttaaccttagtgactaaggacatcacatatgaagaatgtttaagttggaggtggcagcgtgaattgcaaacagggcctgcttcagtgactgtgtgcctgtagtcccagctactcgggagtctgtgtgaggccaggggtgccagcgcaccagctagatgctctgtaacttctaggccccattttcccctctgaaaataagagggttggttcaaacgatctctggggccttagcatctcaaatcctgggggatcctnctacttaccccttagagagccttactgggaagtcagtcattaatgatggtggcccgtantttgcaagtgggtaaaagcctttttaccnttaataatccn

SEQ ID NO: 657 - DNA, 525 bp, Homo sapiens
  "n" may be a, t, c, g, other or unknown
gagacagagtcttgctctgtcacccaggctggagtgctgtggctggatctcagctcactgcaagctccgcctcccaggttcacaccattctcctgcctcagcctcccgagtagctgggactacaggcacccgccaccacgcccggctaattttttgtatttttagtggaaacagggtttcaccgtgttagccaggatggtcttgatctcctgacctcatgatccgcctgcctcggtctcccaaagtgctggattacaggcgtgagccacctcgcccagcccctaatcttggattcttaagcccaggctctttgtagcttattctccagtatgctttcctccaagcttccagttctgggcttccttaatatgcaattccaaatgtctggattttccagctagagatggggagctcttaactttctggctcctggcccaggctccttaggattcaggactgggtnccaggcangaaaaaaacggcaggtgccaacngggtccctggngntgccganggcaaancaag

SEQ ID NO: 658 - DNA, 546 bp, Homo sapiens
  "n" may be a, t, c, g, other or unknown
gagcagtggattttccttttaatgcaaaatgttgcaatacaaaacaatgtggagaaagtcctgttcctcaggacactgaagggaggagtgaggaagagaggacagagctggacgtctcctcctatttctccctccccaagtcactctgaggggaagaacactgctgcctgctccctgggcctgcccgcatacaaggttagagccctgggtctggggcatccttagcctgaaatttgttgacatggggcaggagagcaggagggaacattgagggttttgactnttcgggctctaaaaggattactcaggatctggagttccgtatgaaacaaaggagctgaaagaatttgattgccattggctaaaaatatagaggatttnagccacaactggcccacatttgaagaatgaggaacaagaaatttantggggatataatataaatgtatgggagtgagaaagatgcaaaagacaaggctagcttctcaaacctnctnctcttcttnctcatnttcactttatagacaatctnggnagccttnaatc

SEQ ID NO: 659 - DNA, 565 bp, Homo sapiens
  "n" may be a, t, c, g, other or unknown
aaaaaatcacatagaactttattaaataaaccagtagaaaggctcctatttacatccaggttgtcagtttaagctcaagtaatatgcaaggcacaattcttcctttctccagctttagaaaaatcaaccacatggcccagccctgaaggactgaagggagcttgtgcgggatcccgtcatcctggactctccacacagcgtccacgcatggatggccatgggcatgagtctctggatctccctgagggtggcccagcctcggcctggagcacaggggcctgtgatctgagaatctcagatccagaatcaggagctgggaagagaggacttttccaagggtctcctcccccaggccctggggagtcccttctggatgggcaggccctgggctggtggccgcctccatcattggcccaagccgggctctagggcccggctgggaactgtctggggccctgcgcctgataagctgncatgaaagtgggccgcttttacactgcangcngtggctcaaaactgcttanggtctggaatgggccangaacnggagggccaaatgaccttg

SEQ ID NO: 660 - DNA, 488 bp, Homo sapiens
  "n" may be a, t, c, g, other or unknown
aaacaaaacaaaataccagnggctagcttttctgtaacatcctttggatttggttaaaaaaagaaagaaaagtctacagaacaggatcactgaatgccactttagccccacttcctgcaggctctgntttaattagcgtcaaacaggttactgaacatttnttcagctgcggaaagaagttctgaatgggtgacagctgcccggagnggctntacctggttccattttacccctcatcagtcagngnggtttcttgccaaacaacacctaacgttttaccccttattcctgcagggaggcgggccctgtggctgactggacacagagaaaaaaaagaaaaactngcacaaacatagagactatacacggagggagagaggagtccctctttctgnttccttcaagaacttgntaaataataacctcnaagtgcaacaatgcacaaatgttngccacaggttantctngagggacttggtattacnggg

SEQ ID NO: 661 - DNA, 539 bp, Homo sapiens
  "n" may be a, t, c, g, other or unknown
gtttttgtgtgtcatcctcagaccagccatttgcctcttccaaaaagctggggctaagcatgtgggtggttcaagaggggcagcccccaggccccaggctgggccgcggtaccagtggcaggtccccctgggtctcaggagcttagcttctacggagctcaggtgtcatttatggggttgccagagcaagctgttaaagggcgaatttggtaagactgagctcanagacctggtgggagggcaaggactggcgggcacagcaggaggagattagaggagggtccacctgaatctttgcagcaggcacagagcttctggctgcatctcagaagggggcagacgcacaggccagggaacacggggctctaggctgtggctccgaatgtccctggtgactggaaagcctgangggaggctggaactgatcaggatcccgtggcttgtgagacagaatgagctctttcttnctgaaaagggcccaaggganaagaanaagagcngacattacactggtccttcatccttgccgnggnaaaaan

SEQ ID NO: 662 - DNA, 470 bp, Homo sapiens
  "n" may be a, t, c, g, other or unknown
cgcnagccacggccacnctttattgcttaagacncacacagaacacagaggaacaaacaaggnggaaagggcnccacacacagcccaaaccaggcaggagcggcccagccgccggaananacgttccttgcaaggcagggcccctgntggacagcacgccccctgggcnacagggtcagggaccccagnactgcacagntgcaaacttgntgggaacctgggacaggtgacacgcccactttcgcctgnggcccagggccttccacctttgcatccagccntgcacccaccatttccccacagggtacaggggcagccttccttgatccacagccaacccttctcctgctgtctctggctgtcagtganacccctntggaaagggcagaancaggcaagccaggcanaagggggcccngggtccactacctgggtaggaatgaccaaanggcgggcaaaagcccttntnc

SEQ ID NO: 663 - DNA, 472 bp, Homo sapiens
  "n" may be a, t, c, g, other or unknown
acaaagacatttattttccccaaaatatacccccagtttacaaaatccctccgagtcccacatttaaattagaagtcctcacatcttccattcctggggcagggagagatgacatccggaaggcatcagaacgtctgaagtctcactctaccagaggccaggagctggccagaggcaagccaggaaaagactgccccagccccagaatagcaccatggtgggggtggggggcagtcccctcggtgtccccaaagcattcctggccctgccctgccccaggctctgccttttctgctgctatgaaaggtccagagggccttggtgcctgcccacctgcccacacctggacagacattttggacaccaccagattctntagccgtggcnaggggctatgtccctctntcaggnttcgncccaaccccatgctctgggtaagaattatgggtgggatgggggtnaggtnttccag

SEQ ID NO: 664 - DNA, 548 bp, Homo sapiens
  "n" may be a, t, c, g, other or unknown
catgctttaagattgagattttattactatgaagggcacatagtatctttattgaaagaaacatttattgaaacattatataaaatgttgactaaattctgtagtgtatttggagtgaacatcatcttgaatagagattttaaaatttcataatcttaacctccgacgatatgattatacttgtttaaaaagaacattatatccagatataaacttaacaaatgaaatattacaaaatatgaacatagatagttttgtttcccattataattcccagcattttcaccctgtcctgttcatacgagtcaattctcttcttcaattcctgtcccatcagccgtctgctgaaaaacactgctttgtcttggctaaggctgcacaagttcagtctcgcactggctcagcctcccctttcagcgacaccatttccctaccagggtacaagctggtttccctggtgctctaggtggagctggatttggcattcgttccccatccctagtgctctttaagctggtncctgaagtcacaagaaacncttttggttg

SEQ ID NO: 665 - DNA, 600 bp, Homo sapiens
  "n" may be a, t, c, g, other or unknown
cttttttttttttgagatggacgtctcactctgtcgtccaggctggagtgcagnggtgtgatcacagctcagtgcagngaactcctggactcaagccaccctcccacttcagcctcccaagtagccgggacaacaagcacaagccaccacacctggctaatttttaaaatattttgtagcgatgggggcctccctgtgtttcccaggctgatctcgacctccgaggctcaatcgatacccccacctcggtctcccaaagtgttgggattacaggcttgacgactgtgcccggcctgggctttttggaatgagtcttcctggtcccgacagttctcctgcatgtccttgtggtggccagtctctgttctttgatgacgaatttgctttctgagtagagtctggtcacctggagctggtttggtggaataaaggacaatgggtttctaggatgtagctgggagaatcagctgtgagtactctaatatgagataagtttcttatgcaggcccaattggtcctgaagtccttcttnaagaggcgaatcttgaaacctaccccaagtgacgtgagcntnaggagaatgcnccttgcngcaancnt

SEQ ID NO: 666 - DNA, 586 bp, Homo sapiens
  "n" may be a, t, c, g, other or unknown
gccttagacacagaagctttatttttctataaaattattcccgagagaaattttcttttaaatgcccaaagtaaataacttatatcccttcttgaaaacatccccaaagatagtctgtcagaaatccttcggtcaagcaggtcagctggctcccatggcccttggggtggcctgactctgtcactattcctaaaaccttctaggacatctgctccaggaagaactttcaacaccaaaattcatctcaattttacagatgggaaaagtgattctgagaccagaccagggtcaggccaaggtcatccagcatcagtggctgggctgagactgggcccagggaaccctgtctgctcctctttttcccagagctgtgagttctctagccaaggctgcactcttgagggagagccaggaagcatagctgaggccatgacaacctcactcttcacctgaaaatttaacccgtggcanangatccaggcacatataggcttcggagcccaacaggcctaaagaaatagttgaacactttcttccccagncatntncctggagtcaaggtttgccangnttaaatgcaaggnan

SEQ ID NO: 667 - DNA, 558 bp, Homo sapiens
  "n" may be a, t, c, g, other or unknown
ggattgaataatttattccctgtattattatagtaacaggagcaaatacataaatttttattaataaaacaaaaaagatgaaaaacagaagcaacaaatgaagacatccatactgcccataacacatcagccatatgatcagaaaacccatttctaaagagcaatggttgctggtgtcacagagttttattgcattcatcgggggaaagggagatggttggaatgaaaaagatccatcagtcttctgacaggaagatgttatatgggggctccaacccctaactgggtactcctcttgctaccacctttggagcagaagatgaaggggagagggagcttctccctatggcctcatggcttcttgtgagacagatcagtccagccagatacagagcaaagcagctttgcatcaccacaggccagttgctgatgcccagctttatgtctaaaaaaaaaaaaagtggaagcctcaagggggatggaggattgccagaaaaatgggtgccctgggcccanaggcntttnngganaaggaaaccatgnttttaataggggtnt

SEQ ID NO: 668 - DNA, 567 bp, Homo sapiens
  "n" may be a, t, c, g, other or unknown
gctaggtgattacaacagctgatttttatttttcttcttgattctcttctacagtttccaaattctctacaatgaacatgtacttctttttaatatcaaaagacaaaagaattggtacgtaaaaagaacatccttcccatcttcaaggtcaagattgaacgctgactcctgcaggaagtcttccaggattcccaggcaggaatgatggctccctgtccctgtagctccaggagttcttgcttcacgcacgcctcacataccagactgaatgttggcaggaggagtgaccaggtcggtcatctgtgtccctaccacctacaacaggccagcaatctacccgngtgtgtttgttggacagaattaaccatgatgggcggncgaaggcccctggagctatttgggggcttggagagaacctcttangaagaagtggtcangccctaggccagggcaccagaaggaggcaagcttaagnccttggaatggtgggaatggaaacccanacgggactggcatgggnccacaagttnttaccccaaganggcttcagganaagcttaaggnccc

SEQ ID NO: 669 - DNA, 561 bp, Homo sapiens
  "n" may be a, t, c, g, other or unknown
gatttaagaaagaaattttactgtgtctttcatacacaaaagctgattaacaatggttaaaaaaacactactccactttttcacaggtgtacaaaaggaaatataatggaattacattcaacaataaagcttaaagttcactctaggtaatagttgcattaacattcacatacacaagcacagagtaagtatatttcaggagtcttagcatagcatacagcatacatatgggagattgatttcaggtaacatcataggtgttagtaagattagcaattcagagtgttatagaaaaggaaaactaaaccaaagagaaggtgtaggctagcacaccaagacaagtcacagaattagtagattgaaaaatccgctcactgtatgagaaaacaatatttttcttcaatttttgggtcttgatatatagttggttagagaaaggtgtgtatcaaagtgcccataattggttcttagaaaagagagagagagagagaaaggagggaccttttanttaagnattcctgccaagaggcagccccaagtggcccggaaagagtaaacttg

SEQ ID NO: 670 - DNA, 569 bp, Homo sapiens
  "n" may be a, t, c, g, other or unknown
ggctttttaaccatcgtctctttatttacagctcaagagcacatgcaacatgacatcatgaaactacaagggcgtggcacttccccctccccctgccgctccccaactttaaaaaggaagtacagcaccctaggaagttgcctaagagtcagaaaaccctacactgagggtcccaggccgaggtgctccattcattgcctccaaaaataaagaccagttgcagcccaggaggcttgggcctcanagcctgggagtttgtcattgctggtaattagctacgcaaaacaggtctcggatttgccagctcacacctgaatacaaatagcccgaattatccgaatgtccctgaccaccccacatttctgntttccccgtcgtatcctagacctgngattctcaaatttgatcgtgcccaagaatgacctggagaacttgtgaaaagcccaatggnttgggccccaccccagagattttggttaataggcttgggtggtgggggcccaanaatctgnattctttttgggnttttggctttttttggacaagggnttgctggattgcctaactgg

SEQ ID NO: 671 - DNA, 553 bp, Homo sapiens
  "n" may be a, t, c, g, other or unknown
gattcttaacatatttaatgaaactcgagcttcataaaccagtgaaatgcctacccctatggagacggggagctggtcatgggacccaggtgcctggaggacatcccagtggctttgaaggctccagccagtcaagacggtcaatattagcccttctgccaacatctggcaatgtgaggctggggtggacgttggcctgatgttgccaggagtaggatgctgatgctgccagagagtaggtgggctccaaaccccaggcttctcacttgcttactaagcacagcagtctgaagcttgggacctggcagtgcgtctttggagaaggcaaaaaagccacagcagcaacacttaggagcaagacccttcccgctctccaccctatttcctcccctgaagaagagcaacagctcaagctctagcatggcacagaacgctaggttgggccaggcaagcagccatggtggggccaggtgaagcaatgtgggtcttaacaaggaaccctnttgaagtggcaatggcttccaaggcttgttgacaactggacaccanaatt

SEQ ID NO: 672 - DNA, 490 bp, Homo sapiens
  "n" may be a, t, c, g, other or unknown
cctgaaatgtaaattggttttaatatatttaagagcacacagaantcttgatttataaaaaaataaatntatnacatgacaaatttactgatgatccnggagctctgaggtcaaactctttaaatgatcagtgaaaacataaaacatccatgatctgttaacacacacaggagcatattccagttgtaaaaaacaaattccttgaaggctcagaacgaacaaaaatcagtctttatggcagaaagcacatccaaagctaggcaatgaagttcagcctgggccacgtgaacctttnaccagccagcctataacctatggagccaggacaggaaagcatgatccttcactcatgaccgccacccanggcttccagacactgngaatggaaagaagtccttanaaggttcccaagccctgntggcctcattnaaccccgggaagggattggttttggcccttancggggtnttgncctaaatttgagagccng

SEQ ID NO: 673 - DNA, 399 bp, Homo sapiens
  "n" may be a, t, c, g, other or unknown
cttttttttttttttatagaaatcaccctggttnattnttttcaacaaaggaaaaanaaacatggntcaataattcagcatttgggactctggcnagtactgtctgcattgttcaaaataagtgttcctggctgtgagctctgcaacacatactgatggcccangaaccttcttccatggntctaataaaacaaaggacccacacatggaggttacgtgagtcaacaaaagatgctctatcacaatgtgcgtaaaaagcaagtctttnaaaaatatccagatctctaaaggaatacaaacactnctatttggttttgttnttgttcatcttcagtattatattntagttgttgangaaaaatttttttactggaaanggaacggngttatattgacntt

SEQ ID NO: 674 - DNA, 530 bp, Homo sapiens
  "n" may be a, t, c, g, other or unknown
catttgtcacttgctttatgcaaacattcgagtgtacctctttcaccacagggctagagatggtctactctgtacatacatttcacaacaaagaaaaattctgtcattccccaactctatgaccaaggaaaacttttaggatttctttaatttgtagcagagacacagtggcctagccaatcggcagtgctatacacacagtatgccagtttcccacccctaccctctttctccttttttaaagcttcaaaggttagatcaataaaatttaaaatttcctcatttaaggagaaatataatgacccacatgttaatttatattaaaaactaaaaataaataatggggttcttaaacaaggacatctttaactaggttatgattagaccagcctgtgggtgaaatgagagattatctcttctccctggaaatgcttcaaggctcagacaatcagtaggttttaaaaaggtccaacttacacatttnaggtggaaagtttaggcaanggcaccaaccagaaccttggtntgcc

SEQ ID NO: 675 - DNA, 543 bp, Homo sapiens
  "n" may be a, t, c, g, other or unknown
cattttctccattttatttgtcaatataaaaatactcaaatatttacaacaaataaatacgcggggacacaataagttacactgttaggagccctcctcctagggctggaagagagtatgccattgtccacagcaggcccaccctctcccttctctcccctcacacagcctttcccagccctgtacaggaagaaggcaagtataaaataccactgaaccccggggccaagtgggaggccccacccacccttccccccaaacacacaggaggctccatctccctccccccaccctgaaaacattcacagccctaggagcaggactaggcccaccccaagccctgcactccctctgaaggggcacagcaccctgtccaccccacctccatatgtacatcgctgcccgacacttggggcagngggggtaggagagacaaagtgatacgaccccttcccttcatagcttcaatgacttaccaaggaggacccangccanggggagaacttgacagaaacnggaaggntttgncanaagcgcgcangc

SEQ ID NO: 676 - DNA, 541 bp, Homo sapiens
  "n" may be a, t, c, g, other or unknown
gagatggagtctcgctctgttgccaggctggagtgcagtggtgtgatcttggctcactgaaacctccatctcctgagttcaagtgattctcgtgcctcancctcctgtgtagctgggattacaggctcctgccaccacacccagctaatttttatatttttagtaganacggggtttcaccatgttggccaggatggtctcgaactcctgacctcgtgatctgcctgccttggcctcccaaagtgctgagattacaggcgtaagtcactgcgcctggccagggagtccttttctaactgagcctatttttctcttaggtcaaatggaataagtgacaaactctaatttgtagaaacattttaggccatgtataagttacactgattttagcactaagctatatttttatcacagatgggtcaccttaaaagaaaactaaggagatggaatgaatctggaaactttctnaatccaggnagttnacacccttactcaaccgnaantttaaaccnggatttaaaagaaccttttttttganaca

SEQ ID NO: 677 - DNA, 541 bp, Homo sapiens
  "n" may be a, t, c, g, other or unknown
agaaaaaaagaaaaaagtttaatagcgatatagaaaattgagcacctataaaactatatggtgggctctgggttacattgagcttaagtagaccaagtatctatcccacctaaattatcagcaactccaggccatgacccagtgtcccattctccttcacggtttgctggtgtgtagcctcctggatacaggcaatgtatatagatcgcagagaatgtccgttctggcctcttccttggaagggtctaaaaacagaccttaaggagctaagtgacttccccaaagcccacagctccagtgccactgctgacttttgggtgggggtgggatcagttaaagaggaaagctttcagtactgtcagcacatacacctgccaattaaggggctgaatagagttcatctctaggagcaggaccttcacccccacccttcaccccagaagccatgtcatgctggttcaccaggatcttgcctgaaggtaaaatgggaaagaaccgnttccaactttggtgggagncttattaaccccnccttgaagnt

SEQ ID NO: 678 - DNA, 510 bp, Homo sapiens
  "n" may be a, t, c, g, other or unknown
gngtgtaaagggtttttattggagagcctgtggcgctgaagtgccaccaaggatttggaaggtcactttcagcagccgccatttctgccaggaccagtggcaagcacctggcagatggagcccgggtgtttctgcgtaaggcagaggaatccagcttttccatgagattcagctgcagttgtcgaaaaccctgtgtgagccagcagttccagttcaaaggttgagggggcgaacagctgcnaggnggccaggctcccgtgagtcaccactcaggcctgagtacaccgtggagaggagagataaagcagccacggntgttctgttgccagtcccacccctntggcaaacagatgggggaaaacagggaaggaaagcaacaaagaaggtgaaatgcanggagcagagactncacgcaggccccccgtggctngcaataccatcctgctgggcccgntgtgcacctttaccagggnttccacgggcttctggtnttttcctgtaaaggcnaan

SEQ ID NO: 679 - DNA, 510 bp, Homo sapiens
  "n" may be a, t, c, g, other or unknown
gcataggcattactagggacataaatgggagactggcatagaaagtggtgaggagccgaagccaaggaattgctttaaacacaagatgaaaatactctgttctgtccaaagcatcacctaatggtgtgaggcatctcacttagctgtggagaagtccttggaattagatctcagaaagacagctttaagacagtaaaaccttttggcaatgggctaattgccttaaaagaagagttctacctgaaagaccttgcaggtggagaaattgtcctacaaagattcttggatatgttagtggagataactgacatgggtagctgtgggtcaaccaggaactgtcaacaacctgatctctgcaaaaccaggatggccagttaatggtttattcagttctctgatggtcacaaatgtaattttatttanccttgtggaggttctgcaacaaatgtaattttaaaggaattnggagccngaangataaatcaactcctttaactacntgacanggcn
